(12) United States Patent
Yu et al.

(10) Patent No.: US 11,999,953 B2
(45) Date of Patent: Jun. 4, 2024

(54) COMPOSITIONS AND METHODS FOR TREATING TRANSPOSON ASSOCIATED DISEASES

(71) Applicant: THE CHILDREN'S MEDICAL CENTER CORPORATION, Boston, MA (US)

(72) Inventors: Timothy Yu, Boston, MA (US); Eunjung Alice Lee, Boston, MA (US)

(73) Assignee: The Children's Medical Center Corporation, Boston, MA (US)

( * ) Notice: Subject to any disclaimer, the term of this patent is extended or adjusted under 35 U.S.C. 154(b) by 558 days.

(21) Appl. No.: 16/645,083

(22) PCT Filed: Sep. 12, 2018

(86) PCT No.: PCT/US2018/050576
§ 371 (c)(1),
(2) Date: Mar. 6, 2020

(87) PCT Pub. No.: WO2019/055460
PCT Pub. Date: Mar. 21, 2019

(65) Prior Publication Data
US 2020/0263173 A1 Aug. 20, 2020

Related U.S. Application Data

(60) Provisional application No. 62/682,031, filed on Jun. 7, 2018, provisional application No. 62/593,649, filed on Dec. 1, 2017, provisional application No. 62/558,036, filed on Sep. 13, 2017.

(51) Int. Cl.
*C12N 15/113* (2010.01)
*C12Q 1/68* (2018.01)

(52) U.S. Cl.
CPC .............. *C12N 15/113* (2013.01); *C12Q 1/68* (2013.01); *C12N 2310/31* (2013.01); *C12N 2310/321* (2013.01); *C12N 2310/33* (2013.01)

(58) Field of Classification Search
CPC .............. C12N 15/113; C12N 2310/31; C12N 2310/321; C12N 2310/33; C12N 2320/33; C12N 2320/34; A61K 31/712; A61K 31/7125
See application file for complete search history.

(56) References Cited

U.S. PATENT DOCUMENTS

| | | |
|---|---|---|
| 3,687,808 A | 8/1972 | Merigan, Jr. et al. |
| 4,426,330 A | 1/1984 | Sears |
| 4,469,863 A | 9/1984 | Ts'o et al. |
| 4,476,301 A | 10/1984 | Imbach et al. |
| 4,534,899 A | 8/1985 | Sears |
| 4,587,044 A | 5/1986 | Miller et al. |
| 4,605,735 A | 8/1986 | Miyoshi et al. |
| 4,667,025 A | 5/1987 | Miyoshi et al. |
| 4,762,779 A | 8/1988 | Snitman |
| 4,789,737 A | 12/1988 | Miyoshi et al. |
| 4,824,941 A | 4/1989 | Gordon et al. |
| 4,828,979 A | 5/1989 | Klevan et al. |
| 4,835,263 A | 5/1989 | Nguyen et al. |
| 4,845,205 A | 7/1989 | Dinh et al. |
| 4,876,335 A | 10/1989 | Yamane et al. |
| 4,904,582 A | 2/1990 | Tullis |
| 4,948,882 A | 8/1990 | Ruth |
| 4,958,013 A | 9/1990 | Letsinger |
| 4,981,957 A | 1/1991 | Lebleu et al. |
| 5,013,556 A | 5/1991 | Woodle et al. |
| 5,013,830 A | 5/1991 | Ohtsuka et al. |
| 5,023,243 A | 6/1991 | Tullis |
| 5,034,506 A | 7/1991 | Summerton et al. |
| 5,082,830 A | 1/1992 | Brakel et al. |
| 5,108,921 A | 4/1992 | Low et al. |
| 5,109,124 A | 4/1992 | Ramachandran et al. |
| 5,112,963 A | 5/1992 | Pieles et al. |
| 5,118,800 A | 6/1992 | Smith et al. |
| 5,118,802 A | 6/1992 | Smith et al. |
| 5,130,302 A | 7/1992 | Spielvogel et al. |

(Continued)

FOREIGN PATENT DOCUMENTS

| | | | |
|---|---|---|---|
| WO | 2000061595 A1 | 10/2000 | |
| WO | WO-2006000057 A1 * | 1/2006 | .............. A61P 21/00 |

OTHER PUBLICATIONS

Taniguchi-Ikeda et al (Nature 478: 127-131, 2011) (Year: 2011).*
Taniguchi-Ikeda et al (Nature 478: 127-131, 2011, Supplementary information) (Year: 2011).*
Adkin et al (In: Aartsma-Rus, A. (eds) Exon Skipping. Methods in Molecular Biology, vol. 867: 169-188. (2012) (Year: 2012).*
Aartsma-Rus (In: Aartsma-Rus, A. (eds) Exon Skipping. Methods in Molecular Biology, vol. 867: 117-129. (2012) (Year: 2012).*
Hancks et al., "Roles for retrotransposon insertions in human disease," Mobile DNA, May 6, 2016, vol. 7, No. 9, pp. 1-28.

(Continued)

*Primary Examiner* — Richard A Schnizer
(74) *Attorney, Agent, or Firm* — Melissa Hunter-Ensor; Nathan Hsu; Greenberg Traurig, LLP

(57) ABSTRACT

The present invention features antisense oligonucleotides (AONs) for the treatment of diseases and disorders associated with the deleterious effects of transposable element insertion (e.g., long interspersed nuclear element-i (LINE-1), *Arthrobacter luteus* element (Alu), short interspersed nuclear element variable number tandem repeat *Arthrobacter luteus* element (SINE-VNTR-Alu) or (SVA), or endogenous retrovirus (ERV). In one aspect, the invention provides one or more antisense oligonucleotides complementary to a transposable element present in an intronic sequence within a gene. In another aspect, the invention provides a method for treating a subject having a genetic disorder associated with the insertion of a transposable element, the method involving administering to the subject one or more antisense oligonucleotides of any aspect delineated herein.

5 Claims, 34 Drawing Sheets
Specification includes a Sequence Listing.

(56) References Cited

U.S. PATENT DOCUMENTS

| | | |
|---|---|---|
| 5,134,066 A | 7/1992 | Rogers et al. |
| 5,138,045 A | 8/1992 | Cook et al. |
| 5,149,797 A | 9/1992 | Pederson et al. |
| 5,166,315 A | 11/1992 | Summerton et al. |
| 5,175,273 A | 12/1992 | Bischofberger et al. |
| 5,177,196 A | 1/1993 | Meyer, Jr. et al. |
| 5,185,444 A | 2/1993 | Summerton et al. |
| 5,188,897 A | 2/1993 | Suhadolnik et al. |
| 5,213,804 A | 5/1993 | Martin et al. |
| 5,214,134 A | 5/1993 | Weis et al. |
| 5,214,136 A | 5/1993 | Lin et al. |
| 5,216,141 A | 6/1993 | Benner |
| 5,218,105 A | 6/1993 | Cook et al. |
| 5,220,007 A | 6/1993 | Pederson et al. |
| 5,227,170 A | 7/1993 | Sullivan |
| 5,235,033 A | 8/1993 | Summerton et al. |
| 5,245,022 A | 9/1993 | Weis et al. |
| 5,254,469 A | 10/1993 | Warren, III et al. |
| 5,256,775 A | 10/1993 | Froehler |
| 5,258,506 A | 11/1993 | Urdea et al. |
| 5,262,536 A | 11/1993 | Hobbs, Jr. |
| 5,264,221 A | 11/1993 | Tagawa et al. |
| 5,264,423 A | 11/1993 | Cohen et al. |
| 5,264,562 A | 11/1993 | Matteucci |
| 5,264,564 A | 11/1993 | Matteucci |
| 5,272,250 A | 12/1993 | Spielvogel et al. |
| 5,276,019 A | 1/1994 | Cohen et al. |
| 5,278,302 A | 1/1994 | Caruthers et al. |
| 5,286,717 A | 2/1994 | Cohen et al. |
| 5,292,873 A | 3/1994 | Rokita et al. |
| 5,317,098 A | 5/1994 | Shizuya et al. |
| 5,319,080 A | 6/1994 | Leumann |
| 5,321,131 A | 6/1994 | Agrawal et al. |
| 5,354,844 A | 10/1994 | Beug et al. |
| 5,356,633 A | 10/1994 | Woodle et al. |
| 5,359,044 A | 10/1994 | Cook et al. |
| 5,366,878 A | 11/1994 | Pederson et al. |
| 5,367,066 A | 11/1994 | Urdea et al. |
| 5,371,241 A | 12/1994 | Brush |
| 5,391,723 A | 2/1995 | Priest |
| 5,393,878 A | 2/1995 | Leumann |
| 5,395,619 A | 3/1995 | Zalipsky et al. |
| 5,399,676 A | 3/1995 | Froehler |
| 5,403,711 A | 4/1995 | Walder et al. |
| 5,405,938 A | 4/1995 | Summerton et al. |
| 5,405,939 A | 4/1995 | Suhadolnik et al. |
| 5,414,077 A | 5/1995 | Lin et al. |
| 5,416,016 A | 5/1995 | Low et al. |
| 5,416,203 A | 5/1995 | Letsinger |
| 5,417,978 A | 5/1995 | Tari et al. |
| 5,432,272 A | 7/1995 | Benner |
| 5,434,257 A | 7/1995 | Matteucci et al. |
| 5,446,137 A | 8/1995 | Maag et al. |
| 5,451,463 A | 9/1995 | Nelson et al. |
| 5,453,496 A | 9/1995 | Caruthers et al. |
| 5,455,233 A | 10/1995 | Spielvogel et al. |
| 5,457,187 A | 10/1995 | Gmeiner et al. |
| 5,459,127 A | 10/1995 | Felgner et al. |
| 5,459,255 A | 10/1995 | Cook et al. |
| 5,462,854 A | 10/1995 | Coassin et al. |
| 5,466,677 A | 11/1995 | Baxter et al. |
| 5,466,786 A | 11/1995 | Buhr et al. |
| 5,469,854 A | 11/1995 | Unger et al. |
| 5,470,967 A | 11/1995 | Huie et al. |
| 5,476,925 A | 12/1995 | Letsinger et al. |
| 5,484,908 A | 1/1996 | Froehler et al. |
| 5,486,603 A | 1/1996 | Buhr |
| 5,489,677 A | 2/1996 | Sanghvi et al. |
| 5,491,133 A | 2/1996 | Walder et al. |
| 5,502,177 A | 3/1996 | Matteucci et al. |
| 5,510,475 A | 4/1996 | Agrawal et al. |
| 5,512,295 A | 4/1996 | Kornberg et al. |
| 5,512,439 A | 4/1996 | Hornes et al. |
| 5,512,667 A | 4/1996 | Reed et al. |
| 5,514,785 A | 5/1996 | Ness et al. |
| 5,519,126 A | 5/1996 | Hecht |
| 5,519,134 A | 5/1996 | Acevedo et al. |
| 5,521,291 A | 5/1996 | Curiel et al. |
| 5,525,465 A | 6/1996 | Haralambidis et al. |
| 5,525,711 A | 6/1996 | Hawkins et al. |
| 5,527,528 A | 6/1996 | Allen et al. |
| 5,534,259 A | 7/1996 | Zalipsky et al. |
| 5,536,821 A | 7/1996 | Agrawal et al. |
| 5,539,082 A | 7/1996 | Nielsen et al. |
| 5,541,306 A | 7/1996 | Agrawal et al. |
| 5,541,307 A | 7/1996 | Cook et al. |
| 5,541,313 A | 7/1996 | Ruth |
| 5,543,152 A | 8/1996 | Webb et al. |
| 5,543,158 A | 8/1996 | Gref et al. |
| 5,545,730 A | 8/1996 | Urdea et al. |
| 5,547,932 A | 8/1996 | Curiel et al. |
| 5,550,111 A | 8/1996 | Suhadolnik et al. |
| 5,552,538 A | 9/1996 | Urdea et al. |
| 5,552,540 A | 9/1996 | Haralambidis |
| 5,556,948 A | 9/1996 | Tagawa et al. |
| 5,561,225 A | 10/1996 | Maddry et al. |
| 5,563,253 A | 10/1996 | Agrawal et al. |
| 5,565,350 A | 10/1996 | Kmiec |
| 5,565,552 A | 10/1996 | Magda et al. |
| 5,567,810 A | 10/1996 | Weis et al. |
| 5,567,811 A | 10/1996 | Misiura et al. |
| 5,571,799 A | 11/1996 | Tkachuk et al. |
| 5,574,142 A | 11/1996 | Meyer, Jr. et al. |
| 5,576,427 A | 11/1996 | Cook et al. |
| 5,578,717 A | 11/1996 | Urdea et al. |
| 5,578,718 A | 11/1996 | Cook et al. |
| 5,580,575 A | 12/1996 | Unger et al. |
| 5,580,731 A | 12/1996 | Chang et al. |
| 5,583,020 A | 12/1996 | Sullivan |
| 5,585,481 A | 12/1996 | Arnold, Jr. et al. |
| 5,587,361 A | 12/1996 | Cook et al. |
| 5,587,371 A | 12/1996 | Sessler et al. |
| 5,587,469 A | 12/1996 | Cook et al. |
| 5,591,584 A | 1/1997 | Chang et al. |
| 5,591,721 A | 1/1997 | Agrawal et al. |
| 5,591,722 A | 1/1997 | Montgomery et al. |
| 5,594,121 A | 1/1997 | Froehler et al. |
| 5,595,726 A | 1/1997 | Magda et al. |
| 5,595,756 A | 1/1997 | Bally et al. |
| 5,596,086 A | 1/1997 | Matteucci et al. |
| 5,596,091 A | 1/1997 | Switzer |
| 5,597,696 A | 1/1997 | Linn et al. |
| 5,597,909 A | 1/1997 | Urdea et al. |
| 5,599,923 A | 2/1997 | Sessler et al. |
| 5,599,928 A | 2/1997 | Hemmi et al. |
| 5,602,240 A | 2/1997 | Mesmaeker et al. |
| 5,608,046 A | 3/1997 | Cook et al. |
| 5,610,289 A | 3/1997 | Cook et al. |
| 5,610,300 A | 3/1997 | Altmann et al. |
| 5,614,617 A | 3/1997 | Cook et al. |
| 5,618,704 A | 4/1997 | Sanghvi et al. |
| 5,623,065 A | 4/1997 | Cook et al. |
| 5,623,070 A | 4/1997 | Cook et al. |
| 5,625,050 A | 4/1997 | Beaton et al. |
| 5,627,053 A | 5/1997 | Usman et al. |
| 5,633,360 A | 5/1997 | Bischofberger et al. |
| 5,639,873 A | 6/1997 | Barascut et al. |
| 5,646,265 A | 7/1997 | McGee |
| 5,652,355 A | 7/1997 | Metelev et al. |
| 5,652,356 A | 7/1997 | Agrawal |
| 5,658,873 A | 8/1997 | Bertsch-Frank et al. |
| 5,663,312 A | 9/1997 | Chaturvedula |
| 5,670,633 A | 9/1997 | Cook et al. |
| 5,677,437 A | 10/1997 | Teng et al. |
| 5,677,439 A | 10/1997 | Weis et al. |
| 5,681,941 A | 10/1997 | Cook et al. |
| 5,688,941 A | 11/1997 | Cook et al. |
| 5,700,920 A | 12/1997 | Altmann et al. |
| 5,700,922 A | 12/1997 | Cook |
| 5,714,331 A | 2/1998 | Buchardt et al. |
| 5,719,262 A | 2/1998 | Buchardt et al. |
| 5,750,692 A | 5/1998 | Cook et al. |
| 6,582,908 B2 * | 6/2003 | Fodor .............. C12Q 3/00 506/30 |

(56) References Cited

U.S. PATENT DOCUMENTS

| | | | |
|---|---|---|---|
| 7,473,414 B2 | 1/2009 | Heber-Katz | |
| 8,680,065 B2 | 3/2014 | Xu et al. | |
| 2002/0168631 A1 | 11/2002 | Park et al. | |
| 2003/0219770 A1* | 11/2003 | Eshleman | C12Q 1/6869 435/6.14 |
| 2005/0106584 A1 | 5/2005 | Ast et al. | |
| 2011/0166204 A1 | 7/2011 | Xu et al. | |
| 2012/0028817 A1* | 2/2012 | Kelly | C12Q 1/6813 506/7 |
| 2017/0183655 A1 | 6/2017 | Grabczyk et al. | |

OTHER PUBLICATIONS

Lanikova et al., "β-Thalassemia Due to Intronic LINE-1 Insertion in the β-Globin Gene (HBB): Molecular Mechanisms Underlying Reduced Transcript Levels of the B-Globin(L1) Allele," Human Mutation, Aug. 13, 2013, vol. 34, pp. 1361-1365.

Tappino et al., "An Alu insertion in compound heterozygosity with a microduplication in GNPTAB gene underlies Mucolipidosis II," Molecular Genetics and Metabolism, Oct. 26, 2007, vol. 93, pp. 129-133.

International Search Report and Written Opinion in corresponding PCT Patent Application No. PCT/US2018/050576, dated Feb. 19, 2019 (18 pages).

Fairbrother et al., "RESCUE-ESE identifies candidate exonic splicing enhancers in vertebrate exons," Nucleic Acids Research, 2004, vol. 32, Suppl. 2, pp. W187-W190.

Finkel et al., "Treatment of infantile-onset spinal muscular atrophy with nusinersen: a phase 2, open-label, dose-escalation study," The Lancet, Published Online: Dec. 6, 2016, vol. 388, No. 10063, pp. 3017-3026.

Kabanov et al., "A new class of antivirals: antisense oligonucleotides combined with a hydrophobic substituent effectively inhibit influenza virus reproduction and synthesis of virus-specific proteins in MDCK cells," FEBS Letters, Jan. 1990, vol. 259, No. 2, pp. 327-330.

Letsinger et al., "Cholesteryl-conjugated oligonucleotides: Synthesis, properties, and activity as inhibitors of replication of human immunodeficiency virus in cell culture," Proceedings of the National Academy of Sciences of the United States of America, Sep. 1989, vol. 86, pp. 6553-6556.

Moon et al., "Target site search and effective inhibition of leukaemic cell growth by a covalently closed multiple anti-sense oligonucleotide to c-myb," Biochemical Journal, 2000, vol. 346, pp. 295-303.

Moon et al., "Potent Growth Inhibition of Leukemic Cells by Novel Ribbon-type Antisense Oligonucleotides to c-myb1," The Journal of Biological Chemistry, Feb. 18, 2000, vol. 275, No. 7, pp. 4647-4653.

Nielsen et al., "Sequence-Selective Recognition of DNA by Strand Displacement with a Thymine-Substituted Polyamide," Science, Dec. 6, 1991, vol. 254, No. 5037, pp. 1497-1500.

Oberhauser et al., "Effective incorporation of 2'-O-methyl-oligoribonuclectides into liposomes and enhanced cell association through modification with thiocholesterol," Nucleic Acids Research, 1992, vol. 20, No. 3, pp. 533-538.

Saison-Behmoaras et al., "Short modified antisense oligonucleotides directed against Ha-ras point mutation induce selective cleavage of the mRNA and inhibit T24 cells proliferation," The EMBO Journal, 1991, vol. 10, No. 5, pp. 1111-1118.

Shea et al., "Synthesis, hybridization properties and antiviral activity of lipid-oligodeoxynucleotide conjugates," Nucleic Acids Research, 1990, vol. 18, No. 13, pp. 3777-3783.

Smith et al., "An increased specificity score matrix for the prediction of SF2/ASF-specific exonic splicing enhancers," Human Molecular Genetics, 2006, vol. 15, No. 16, pp. 2490-2508.

* cited by examiner

*Normal MFSD8 gene:*

Proband *MFSD8 gene:*

Native MFSD8 splicing:

After transposon insertion:

...MFSD8 gene truncation
& loss of protein function

Exon skipping drug to block the splice acceptor restoration of normal gene splicing

- Chimeric reads with intron 6 sequence fused to polyT

- Chimeric reads with intron 6 sequence fused to tandem GGGAGA repeats

- These indicate the presence of a large insertional event:

This matches the signature of a SVA retrotransposon

Normal *CLN7/MFSD8* allele

Mila's maternal *CLN7/MFSD8* allele

Sanger sequencing primers

Normal *CLN7/MFSD8* splicing and translation

Abnormal *CLN7/MFSD8* splicing and translation after SVA insertion

Lead oligos target the splice acceptor + a downstream site

5' [MOE-A][MOE-A][5Me-MOE-U][MOE-G][5Me-MOE-U][5Me-MOE-U][MOE-A][MOE-G][5Me-MOE-U][MOE-G][5Me-MOE-C][5Me-MOE-U][5Me-MOE-U][MOE-G][5Me-MOE-U] [5Me-MOE-U][MOE-G][MOE-A] [MOE-G][MOE-G][MOE-G] [5Me-MOE-C] 3'

[5Me-MOE-U] indicates 5-Methyl-2'-Methoxyethyl-uridine
[MOE-A] indicates 2'-Methoxyethyl-adenosine
[MOE-G] indicates 2'-Methoxyethyl-guanosine
[5Me-MOE-C] indicates 5-Methyl-2'-Methoxyethyl-cytidine

*FIG. 9 (cont.)*

Genomic matches of milasen/TY777 subsequences

| Length (bp) | Number of possible subsequences | Number of off-target hits | Off-target loci (hg38) | Off-target information |
|---|---|---|---|---|
| 22 | 1 | 0 | – | – |
| 21 | 2 | 0 | – | – |
| 20 | 3 | 0 | – | – |
| 19 | 4 | 0 | – | – |
| 18 | 5 | 0 | – | – |
| 17 | 6 | 0 | – | – |
| 16 | 7 | 7 | chr2:65659662-65659677<br>chr2:31196302-31196317<br>chr5:32260228-32260243<br>chr7:11518139-11518154<br>chr8:132908567-132908582<br>chr14:44054788-44054803<br>chr21:38507523-38507508 | *AC0174391.1* intronic<br>*CAPN14* intronic<br>*MTMR12* intronic<br>*THSD7A* intronic<br>*TG* intronic<br>*RP11-305B6.3* intronic<br>*ERG* intronic |

*FIG. 12*

COMPOSITIONS AND METHODS FOR TREATING TRANSPOSON ASSOCIATED DISEASES

CROSS REFERENCE TO RELATED APPLICATIONS

This application is the U.S. national phase application, pursuant to 35 U.S.C. § 371, of PCT international application Ser. No.: PCT/US2018/050576, filed Sep. 12, 2018, designating the United States and published in English, which claims the benefit of and priority to the following U.S. Provisional Application No. 62/558,036, filed Sep. 13, 2017; 62/593,649, filed Dec. 1, 2017; and 62/682,031, filed Jun. 7, 2018, the entire contents of each of which are incorporated herein by reference.

SEQUENCE LISTING

The instant application contains a Sequence Listing which has been submitted electronically in ASCII format and is hereby incorporated by reference in its entirety. Said ASCII copy, created on Aug. 28, 2020, is named 167705_014204 US_SL.txt and is 631,973 bytes in size.

BACKGROUND OF THE INVENTION

Almost half of mammalian genomes contain repeat DNA sequences known as transposable elements. Many transposable elements (TE) have the ability to mobilize and change locations in the genome. Yet, the role of transposons in human health and disease is not well defined. Barbara McClintock, who discovered transposable elements in corn, proposed two main functions tor transposable elements: (1) insertional mutagens and (2) "controlling elements" that regulate the expression of nearby genes. RNA transposons (herein called retrotransposons) move via a copy-and-paste mechanism using RNA as an intermediate. Retrotransposition-mediated events in mammals are known to produce somatic alterations in the brain, as well as cancer. Current methods for detecting and treating the deleterious effects of TE insertion are required.

SUMMARY OF THE INVENTION

As described below, the present invention features antisense oligonucleotides (AONs) for the treatment of diseases and disorders associated with the deleterious effects of transposable element insertion (e.g., long interspersed nuclear element-1 (LINE-1), *Arthrobacter luteus* element (Alu), short interspersed nuclear element variable number tandem repeat *Arthrobacter luteus* element (SINE-VNTR-Alu) or (SVA), or endogenous retrovirus (ERV).

In one aspect, the invention provides one or more antisense oligonucleotides complementary to a transposable element present in an intronic sequence within a gene.

In another aspect, the invention provides a set of antisense oligonucleotides comprising 2 or more antisense oligonucleotides of any aspect delineated herein. In various embodiments, the set comprises 2-50 antisense oligonucleotides. In particular embodiments, the set comprises 5, 10 or 15 antisense oligonucleotides.

In another aspect, the invention provides a pharmaceutical composition comprising an effective amount of an antisense oligonucleotides of any aspect delineated herein or a set of antisense oligonucleotides of any aspect delineated herein in a pharmaceutically acceptable excipient.

In another aspect, the invention provides a method for treating a subject having a genetic disorder associated with the insertion of a transposable element, the method involving administering to the subject one or more antisense oligonucleotides of any aspect delineated herein.

In another aspect, the invention provides an isolated cell that is heterozygous for a mutation associated with a genetic defect, comprising a genetic mutation and a second allele comprising a retrotransposon insertion. In other embodiments, oligonucleotide therapy is used to correct undesirable splicing in recessive (homozygous), homozygous (compound heterozygous), or dominant (heterozygous) disease. In other embodiments, the cell is a fibroblast.

In another aspect, the invention provides a method of identifying an agent that inhibits a splicing event caused by a retrotransposon insertion, the method involving contacting a cell according to any aspect delineated herein, and detecting a splice product that does not comprise a retransposon sequence or fragment thereof.

In various embodiment of any aspect delineated herein, the oligonucleotide comprises a modified backbone. In various embodiments, the modified backbone comprises a 2' methoxy ethyl modification or a 2' O-methyl modification. In various embodiments the antisense oligonucleotide binds a splice acceptor site present in the LINE-1, Alu, SVA, or ERV. In various embodiments, the antisense oligonucleotide comprises or consists of a sequence listed in Table 1. In various embodiments, the antisense oligonucleotide comprises at least one modified sugar moiety, e.g., a 2'-O-methyl group or a 2'-O-methoxyethyl group. In various embodiments, the nucleobase oligomer comprises at least one modified nucleobase. In various embodiments, the oligonucleotide comprises DNA residues, RNA residues, modified DNA or RNA residues, or combinations of any of these.

In various embodiment of any aspect delineated herein, the subject or cell is heterozygous for a mutation associated with a genetic defect. In various embodiment of any aspect delineated herein, the subject or cell comprises a first allele comprising a genetic mutation and a second allele comprising a retrotransposon insertion. In various embodiment of any aspect delineated herein, the transposable element is a retrotransposon. In various embodiments, the retrotransposon is LINE-1, Alu, SVA, or ERV.

Compositions and articles defined by the invention were isolated or otherwise manufactured in connection with the examples provided below. Other features and advantages of the invention will be apparent from the detailed description, and from the claims.

Definitions

Unless defined otherwise, all technical and scientific terms used herein have the meaning commonly understood by a person skilled in the art to which this invention belongs. The following references provide one of skill with a general definition of many of the terms used in this invention: Singleton et al., Dictionary of Microbiology and Molecular Biology (2nd ed. 1994); The Cambridge Dictionary of Science and Technology (Walker ed., 1988); The Glossary of Genetics, 5th Ed., R. Rieger et al. (eds.), Springer Verlag (1991); and Hale & Marham, The Harper Collins Dictionary of Biology (1991). As used herein, the following terms have the meanings ascribed to them below, unless specified otherwise.

By a "nucleobase oligomer" is meant a compound that includes a chain of at least eight nucleobases joined together by linkage groups. Included in this definition are natural and non-natural oligonucleotides, both modified and unmodified, as well as oligonucleotide mimetics such as Protein Nucleic Acids, locked nucleic acids, and arabinonucleic acids. Numerous nucleobases and linkage groups may be employed in the nucleobase oligomers of the invention, including those described in detail herein in the section entitled "Oligonucleotides and other nucleobase oligomers," infra "Hybridization" means hydrogen bonding, which may be Watson-Crick, Hoogsteen or reversed Hoogsteen hydrogen bonding, between complementary nucleobases. For example, adenine and thymine are complementary nucleobases that pair through the formation of hydrogen bonds.

By "promoter" is meant a polynucleotide sufficient to direct transcription.

By "operably linked" is meant that a first polynucleotide is positioned adjacent to a second polynucleotide that directs transcription of the first polynucleotide when appropriate molecules (e.g., transcriptional activator proteins) are bound to the second polynucleotide.

Transposable elements are known in the art. The following exemplary sequences are provided for SVA transposons.

An "SVA transposon" comprises the Sequence of any of SVA1-6 or has at least about 85% identity to such sequence.

SVA1
CTCTCCCTCTCCCTCTCCCTCTCCCTCTCCCTCTCCCTCTCCCT
CTTTCTACGGTCTCCCTCTGTTGCCGAGGCTGGACTGTACTGCCGTGATCT
CGGCTCGCTGCAACCTCCCTGCCTCGGGCTCCAGTGATTCTCCTGCCTCGG
CCTGCCGAGTGCCTGGGATTGCAGGCACGCGCCGCCACGCCTGACTGGTTT
TTGTATTTTTGGTGGAGACGGGGTTTCGCTGTGTTGACCGGGCTGGTCTCC
AGCTCCTGGCCTCGAGTGATCTGCCCGCCTCGGCCTCCCGAGGTGCTGGGA
TTGCAGACGGAGTCTCGCTCACTCAGTGCTCAATGTTGCCCAGGCTGGAGT
GCAGTGGCGTGATCTCGGCTCGCTACAACCTCCACCTCCCAGCCGCCTGCC
TTGGCCTCCCAAAGTGCTAAGATTGCAGCCTCTGCCCGGCCGCCACCCCGT
CTGGGAAGTGAGGAGCGTCTCTGCCTGGCCGCCCATCGTCTGGGATGTGAG
GAGCCCCTCTGCCCGGCCGCCCCGTCTGGGAAGTGAGGAGCGCCTCTGCCC
GGCCGCCACCCCGTCTGGGAAGTGAGGAGCGTCTCTGCCCGGCCGCCCATC
GTCTGGGATGTGAGGAGCGCCTCTGCCCGGCCGCCCCGTCTGGGATGTGAG
GAGCGCCTCTGCCCGGCCAGCCGCCCCGTCTGGGAGGTGGGGGGTCAGCC
CCCCGCCCGGCCAGCCGCCCCGTCTGGGAGGAGGTGGGGGGGTCAGCCCCC
CGCCCGGCCAGCCGCCCCGTCTGGGAGGTGAGGGGCGCCTCTGCCCGGCCG
CCCCTTCTGGGAAGTGAGGAGCCCCTCTGCCCGGCCACCGCCCCGTCTGGG
AGGTGTACCCAGCGACCATTGAGAACGGGCCATGATGACGATGGCGGTTTT
GTCGAAAAGAAAAGGGGGAAATGTGGGAAAAGAAAGAGAGATCAGATTGT
TACTGTGTCTGTGTAGAAAGAAGTAGACATAGGAGACTCCATTTTGTTCTG
TACTAAGAAAAATTCTTCTGCCTTGGGATGCTGTTAATCTATAACCTTACC
CCCAACCCCGTGCTCTCTGAAACATGTGCTGTGTCAACTCAGGGTTAAATG
GATTAAGGGCGGTGCAAGATGTGCTTTGTTAAACAGATGCTTGAAGGCAGC
ATGCTCGTTAAGAGTCATCACCACTCCCTAATCTCAAGTACCCAGGGACAC
AAACACTGCGGAAGGCCGCAGGGACCTCTGCCTAGGAAAACCAGAGACCTT

TGTTCACGTGTTTATCTGCTGACCTTCTCTCCACTATTATCCTATGACCCT
GCCACATCCCCCTCTCCGAGAAACACCCAAGAATGATCAATAAATACTAAA
AAAAAAAAAA

SVA2
CTCTCCCTCTCCCTCTCCCTCTCCCTCTCCCTCTCCCTCTCCCTGTCCCCT
CTTTCCACGGTCTCCCTCTGATGCCGAGCCGAGGCTGGACTGTACTGCCGC
CATCTCGGCTCACTGCAACCTCCCTGCCTGATTCTCCTGCCTCAGCCTGCC
GAGTGCCTGGGATTGCAGGCGCGCGCCGCCACGCCTGACTGGTTTTTGTAT
TTTTTGGTGGAGACGGGGTTTCGCCGTGTTGGCCGGGCTGGTCTCCAGCTC
CTGACCGCGAGTGATCTGCCCGCCTCGGCCTCCCGAGGTGCCGGGATTGCA
GACGGAGTCTCGCTCACTCAGTGCTCAATGTTGCCCAGGCTGGAGTGCAGT
GGCGTGATCTCGGCTCGCTACAACCTCCACCTCCCAGCCGCCTGCCTTGGC
CTCCCAAAGTGCCGAGATTGCAGCCTCTGCCCGGCCGCCACCCCGTCTGGG
AAGTGAGGAGCGTCTCTGCCTGGCCGCCCATCGTCTGGGATGTGAGGAGCC
CCTCTGCCCGGCCGCCCAGTCTGGGAAGTGAGGAGCGCCTCTTCCCGGCCG
CCATCCCGTCTGGGAAGTGAGGAGCGTCTCTGCCCGGCCGCCCATCGTCTG
GGATGTGGGGAGCGCCTCTGCCCCGCCGCCCCGTCTGGGATGTGAGGAGCG
CCTCTGCCCGGCCAGCCGCCCCGTCTGGGAGGTGGGGGGTCAGCCCCCCG
CCCGGCCAGCCGCCCCGTCCGGGAGGAGGTGGGGGGGTCAGCCCCCCGCCC
GGCCAGCCGCCCCGTCTGGGAGGTGGGGGGCGCCTCTGCCCGGCCGCCCCG
TCTGGGAAGTGAGGAGCCCCTCTGCCCGGCCGCCACCCCGTCTGGGAGGTG
TACCCAACAGCTCATTGAGAACGGGCCATGATGACGATGGCGGTTTTGTCG
AATAGAAAAGGGGGAAATGTGGGGAAAAGAAAGAGAGATCAGATTGTTACT
GTGTCTGTGTAGAAAGAAGTAGACATAGGAGACTCCATTTTGTTCTGTACT
AAGAAAAATTCTTCTGCCTTGGGATGCTGTTAATCTATAACCTTACCCCCA
ACCCCGTGCTCTCTGAAACATGTGCTGTGTCCACTCAGGGTTAAATGGATT
AAGGGCGGTGCAAGATGTGCTTTGTTAAACAGATGCTTGAAGGCAGCATGC
TCGTTAAGAGTCATCACCACTCCCTAATCTCAAGTACCCAGGGACACAAAC
ACTGCGGAAGGCCGCAGGGTCCTCTGCCTAGGAAAACCAGAGACCTTTGTT
CACATGTTTATCTGCTGACCTTCCCTCCACTATTGTCCTATGACCCTGCCA
AATCCCCTCTCCGAGAAACACCCAAGAATGATCAATAAATACTAAAAAAA
AAAAAA

SVA3
CTCTCCCTCTCCCTCTCCCTCTCCCTCTCCCTCTCCCTCTCCCTCTCCCCT
CTTTCCACGGTCTCCCTCTGATGCCGAGCCGAAGCTGGACTGTACTGCTGC
CATCTCGGCTCACTGCAACCTCCCTGCCTGATTCTCCTGCCTCAGCCTGCC
GAGTGCCTGCGATTGCAGGCGCGCGCCGCCACGCCTGACTGGTTTTCGTAT
TTTTTGGTGGAGACGGGGTTTCGCTGTGTTGGCCGGGCTGGTCTCCAGCT
CCTAACCGCGAGTGATCGCCAGCCTCGGCCTCCCGAGGTGCCGGGATTGC
AGACGGAGTCTCGTTCACTCAGTGCTCAATGTTGCCCAGGCTGGAGTGCAG
TGGCGTGATCTCGGCTCGCTACAACCTCCACCTCCCAGCCGCCTGCCTTGG

```
CCTCCCAAAGTGCCGAGATTGCAGCCTCTGCCCGGCCGCCACCCCGTCTGG
GAAGTGAGGAGCGTCTCTGCCTGGCCGCCCATCGTCTGGGATGTGAGGAGC
CCCTCTGCCTGGCTGCCCAGTCTGGGAAGTGAGGAGCGCCTCTTCCCGGCC
GCCATCCCGTCTAGGAAGTGAGGAGCGTCTCTGCCCGGCCGCCCATCGTCT
GAGATGTGGGGAGCGCCTCTGCCCCGCCGCCCCGTCTGGGATGTGAGGAGC
GCCTCTGCCCGGCCAGCCGCCCCGTCTGGGAGGTGGGGGGGTCAGCCCCCC
GCCCGGCCAGCCGCCCCGTCCGGGAGGAGGTGGGGGGGTCAGCCCCCCGCC
CGGCCAGCCGCCCCGTCCGGGAGGTGGGGGGCGCCTCTGCCCGGCCGCCCC
TTCTGGGAAGTGAGGAGCCCCTCTGCCCGGCCACCACCCCGTCTGGGAGGT
GTACCCAACAGCTCATTGAGAACGGGCCATGATGACGATGGCGGTTTTGTG
GAATAGAAAGGGGGGAAAGGTGGGGAAAAGATAGAGAAATCGGATTGTTGC
TGTGTCTGTGTAGAAAGAAGTAGACATGGGAGACTTCATTTTGTTCTGTAC
TAAGAAAAATTCTTCTGCCTTGGGATGCTGTTGATCTGTGACCTTACCCCC
AACCCTGTGCTCTCTGAAACATGTGCTGTGTCCACTCAGGGTTAAATGGAT
TAAGGGCGGTGCAAGATGTGCTTTGTTAAACAGATGCTTGAAGGCAGCATG
CTCGTTAAGAGTCATCACCACTCCCTAATCTCAAGTACCCAGGGACACAAA
CACTGCGGAAGGCCGCAGGGTCCTCTGCCTAGGAAAACCAGAGACCTTTGT
TCACTTGTTTATCTGCTGACCTTCCCTCCACTATTGTCCTATGACCCTGCC
AAATCCCCCTCTGCGAGAAACACCCAAGAATGATCAATAAAAAAAAAAAAA
AAAAAAA
SVA4
CTCTCCCTCTCCCTCTCCCTCTCCCTCTCCCTCTCCCTCTCCCTCTCCCT
CTTTCCACGGTCTCCCTCTGATGCCGAGCCGAAGCTGGACTGTACTGCTGC
CATCTCGGCTCACTGCAACCTCCCTGCCTGATTCTCCTGCCTCAGCCTGCC
GAGTGCCTGCGATTGCAGGCGCGCGCCGCCACGCCTGACTGGTTTTCGTAT
TTTTTTGGTGGAGACGGGGTTTCGCTGTGTTGGCCGGGCTGGTCTCCAGCT
CCTAACCGCGAGTGATCCGCCAGCCTCGGCCTCCCGAGGTGCCGGGATTGC
AGACGGAGTCTGGTTCACTCAGTGCTCAATGGTGCCCAGGCTGGAGTGCAG
TGGCGTGATCTCGGCTCGCTACAACCTCCACCTCCCAGCCGCCTGCCTTGG
CCTCCCAAAGTGCCGAGATTGCAGCCTCTGCCCGGCCGCCACCCCGTCTGG
GAAGTGAGGAGCGTCTCTGCCTGGCCGCCCATCGTCTGGGATGTGAGGAGC
CCCTCTGCCTGGCTGCCCAGTCTGGGAAGTGAGGAGCGTCTCTGCCCGGCC
GCCATCCCATCTAGGAAGTGAGGAGCGTCTCTGCCCGGCCGCCCATCGTCT
GAGATGTGGGGAGCGCCTCTGCCCCGCCGCCCCGTCTGGGATGTGAGGAGC
GCCTCTGCCCGGCCAGCCGCCCCGTCTGGGAGGTGGGGGGGTCAGCCCCCC
GCCCGGCCAGCCGCCCCGTCCGGGAGGAGGTGGGGGGGTCAGCCCCCCGCC
CGGCCAGCCGCCCCGTCCGGGAGGTGAGGGGCGCCTCTGCCCGGCCGCCCC
TACTGGGAAGTGAGGAGCCCCTCTGCCCGGCCACCACCCCGTCTGGGAGGT
GTACCCAACAGCTCATTGAGAACGGGCCATGATGACGATGGCGGTTTTGTG
GAATAGAAAGGGGGGAAAGGTGGGGAAAAGATTGAGAAATCGGATGGTTGC
CGTGTCTGTGTAGAAAGAGGTAGACATGGGAGACTTTTCATTTTGTTCTGT
ACTAAGAAAAATTCTTCTGCCTTGGGATCCTGTTGATCTGTGACCTTACCC
CCAACCCTGTGCTCTCTGAAACATGTGCTGTGTCCACTCAGGGTTAAATGG
ATTAAGGGCGGTGCAAGATGTGCTTTGTTAAACAGATGCTTGAAGGCAGCA
TGCTCGTTAAGAGTCATCACCACTCCCTAATCTCAAGTACCCAGGGACACA
AACACTGCGGAAGGCCGCAGGGTCCTCTGCCTAGGAAAACCAGAGACCTTT
GTTCACTTGTTTATCTGCTGACCTTCCCTCCACTATTGTCCTATGACCCTG
CCAAATCCCCCTCTGCGAGAAACACCCAAGAATGATCAATAAAAAAAAAAA
AAAAAAAA
SVA5
CTCTCCCTCTCCCTCTCCCTCTCCCTCTCCCTCTCCCTCTCCCTCTCCCT
CTCTCCACGGTCTCCCTCTGATGCCGAGCCAAAGCTGGACGGTACTGCTGC
CATCTCGGCTCACTGCAACCTCCCTGCCTGATTCTCCTGCCTCAGCCTGCC
GAGTGCCTGCGATTGCAGGCGCGCGCCGCCACGCCTGACTGGTTTTCGTTT
TTTTTTGGTGGAGACGGGGTTTCGCTGTGTTGGCCGGGCTGGTCTCCAGCT
CCTAACCGCGAGTGATCCGCCAGCCTCGGCCTCCCGAGGTGCCGGGATTGC
AGACGGAGTCTCGTTCACTCAGTGCTCAATGGTGCCCAGGCTGGAGTGCAG
TGGCGTGATCTCGGCTCGCTACAACCACCTCCCAGCCGCCTGCCTTGGCCT
CCCAAAGAGCCGGATTGCAGCCTCTGCCCGGCCGCCACCCCGTCTGGGAAG
TGAGGAGCGTCTCTGCCTGGCCGCCCATCGTCTGGGATGTGAGGAGCCCCT
CTGCCTGGCCGCCCAGTCTGGGAAGTGAGGAGCGCCTCTGCCCGGCCGCCA
TCCCGTCTGGGAAGTGAGGAGCGTCTCTGCCCGGCCGCCCATCGTCTGGGA
TGTGGGGAGCACCTCTGCCCCGCCGCCCCGTCTGGGATGTGAGGAGCGCCT
CTGCCCGGCCAGCCGCCCCGTCCGGGAGGTGGGGGGGTCAGCCCCCCGCCC
GGCCAGCCGCCCCGTCCGGGAGGAGGTGGGGGGGTCAGCCCCCCGCCCGGC
CAGCCGCCCCGTCCGGGAGGTGAGGGGCGCCTCTGCCCGGCCGCCCCTACT
GGGAAGTGAGGAGCCCCTCTGCCCGGCCACCGCCCCGTCTGGGAGGTGTGC
CCAGCGGCTCATTGGGATGGGCCATGATGACAATGGCGGTTTTGTGGAAT
AGAAAGGCGGGAAGGGTGGGAAAAAATTGAGAAATCGGATGGTTGCCGGG
TCTGTGTGGATAGAAGTAGACATGGGAGACTTTTCATTTTGTTCTGTACTA
AGAAAAATTCTTCTGCCTTGGGATCCTGTTGATCTGTGACCTTATCCCCAA
CCCTGTGCTCTCTGAAACATGTGCTGTGTCCACTCAGGGTTAAATGGATTA
AGGGCGGTGCAAGATGTGCTTTGTTAAACAGATGCTTGAAGGCAGCATGCT
CGTTAAGAGTCATCACCACTCCCTAATCTTAAGTACCCAGGGACACAAACA
CTGCGGAAGGCCGCAGGGTCCTCTGCCTAGGAAAACCAGAGACCTTTGTTC
ACTTGTTTATCTGCTGACCTTCCCTCCACTATTGTCCTATGACCCTGCCAA
ATCCCCCTCTGCGAGAAACACCCAAGAATGATCAATAAAAAAAAAAAAAAA
AAAAA
SVA6
CTCTCCCTCTCCCTCTCCCTCTCCCTCTCCCTCTCCCTCTCCCTCTCCCT
CTTTCCACGGTCTCCCTCTCATGCGGAGCCGAAGCTGGACTGTACTGCTGC
CATCTCGGCTCACTGCAACCTCCCTGCCTGATTCTCCTGCCTCAGCCTGCC
GAGTGCCTGCGATTGCAGGCACGCGCCGCCACGCCTGACTGGTTTTGGTGG
```

-continued

```
AGACGGGGTTTCGCTGTGTTGGCCGGGCCGGTCTCCAGCCCCTAACCGCGA
GTGATCCGCCAGCCTCGGCCTCCCGAGGTGCCGGGATTGCAGACGGAGTCT
CGTTCACTCAGTGCTCAATGGTGCCCAGGCTGGAGTGCAGTGGCGTGATCT
CGGCTCGCTACAACCTACACCTCCCAGCCGCCTGCCTTGGCCTCCCAAAGT
GCCGAGATTGCAGCCTCTGCCCGGCCGCCACCCCGTCTGGGAAGTGAGGAG
CGTCTCTGCCTGGCCGCCCATCGTCTGGGATGTGAGGAGCCCCTCTGCCCG
GCCGCCCAGTCTGGGAAGTGAGGAGCGCCTCCGCCCGGCCGCCATCCCGTC
TGGGAAGTGAGGAGCGTCTCTGCCCGGCCGCCCATCGTCTGAGATGTGGGG
AGCGCCTCTGCCCCGCCGCCCCGTCTGGGATGTGAGGAGCGCCTCTGCCCG
GCCAGCCGCCCCGTCTGGGAGGTGGGGGGGTCAGCCCCCCGCCCGGCCAGC
CGCCCCGTCCGGGAGGAGGTGGGGGGGTCAGCCCCCCGCCCGGCCAGCCGC
CCCGTCCGGGAGGTGAGGGGCGCCTCTGCCCGGCCGCCCCTACTGGGAAGT
GAGGAGCCCCTCTGCCCGGCCACCACCCCGTCTGGGAGGTGTGCCCAACAG
CTCATTGAGAACGGGCCAGGATGACAATGGCGGCTTTGTGGAATAGAAAGG
CGGGAAAGGTGGGGAAAAGATTGAGAAATCGGATGGTTGCCGTGTCTGTGT
AGAAAGAAGTAGACATGGGAGACTTTTCATTTTGTTCTGTACTAAGAAAAA
TTCTTCTGCCTTGGGATCCTGTTGATCTGTGACCTTACCCCCAACCCTGTG
CTCTCTGAAACATGTGCTGTGTCCACTCAGGGTTAAATGGATTAAGGGCGG
TGCAAGATGTGCTTTGTTAAACAGATGCTTGAAGGCAGCATGCTCGTTAAG
AGTCATCACCACTCCCTAATCTCAAGTAATCAGGGACACAAACACTGCGGA
AGGCCGCAGGGTCCTCTGCCTAGGAAAACCAGAGACCTTTGTTCACTTGTT
TATCTGCTGACCTTCCCTCCACTATTGTCCCATGACCCTGCCAAATCCCCC
TCTGTGAGAAACACCCAAGAATTATCAATAAAAAAAATTAAAAAAAAA
```

By "antisense oligonucleotide" is meant a nucleobase oligomer that is complementary to a target sequence. The antisense oligonucleotide may contain modified bases, a modified backbone, or any other modification described herein or known in the art. Table 1 provides a list of antisense oligonucleotide (also termed an "AON") directed against an SVA. Such AONs are useful for targeting an SVA present in a human genome.

TABLE 1

Library of Antisense Oligonucleotides Targeting SVA

| | | |
|---|---|---|
| GGGAGGTGGGGGCG | GTGATCTGCCCGCCT | CACCCCGTCTGGGAG |
| CTGACCTTCCCTCCA | GCAAGATGTGCTTTG | AGATAGAGAAATCGG |
| GTCCTCTGCCTAGGA | GGCGTGATCTCGGCT | AGAGAAATCGGATTG |
| GGAAGTGAGGAGCCC | CCTGATTCTCCTGCC | TCCCTCCACTATTGT |
| TACTAAAAAAAAAAA | GCCAGGATGACAATG | AATTGAGAAATCGGA |
| GGGATGCTGTTAATC | ATTGCAGGCGCGCGC | CCCATGACCCTGCCA |
| CACGCGCCGCCACGC | TGCGGAGCCGAAGCT | TGCAAGATGTGCTTT |
| TCTCCAGCTCCTGAC | CAACCTCCCTGCCTG | TACCCAGCGACCATT |
| CGTCCGGGAGGTGGG | TGCTGGGATTGCAGA | GTTGCTGTGTCTGTG |

TABLE 1-continued

Library of Antisense Oligonucleotides Targeting SVA

| | | |
|---|---|---|
| CTGTGTTGGCCGGGC | CAACCTCCCTGCCTC | AGGGACCTCTGCCTA |
| TCTCTGCCTGGCCGC | ACAGCTCATTGAGAA | AGGTGCTGGGATTGC |
| GATTGCAGGCGCGCG | CGCCATCCCATCTAG | TCTGGGAGGTGGGGG |
| TGGGGAAAAGATAGA | TTCATTTGTTCTGT | CTGGGAGGTGTGCCC |
| TGCCCAGGCTGGAGT | AGCCCCTCTGCCTGG | GTTCACATGTTTATC |
| ATGACAATGGCGGTT | TCTCCGAGAAACACC | CAAAGTGCCGAGATT |
| GGTTTTCGTTTTTTT | GGCCGCAGGGTCCTC | TCTGAGATGTGGGGA |
| GGCGCCTCTGCCCGG | CGCCCCTTCTGGGAA | TGGGATTGCAGGCAC |
| AACGGGCCAGGATGA | CTCCCCTCTTTCTAC | CTGCCGTGATCTCGG |
| GCGCCTCTGCCCGGC | CAATAAATACTAAAA | AATGGCGGTTTTGTG |
| TCCGGGAGGTGAGGG | ATGGCGGTTTTGTGG | TGACCCTGCCAAATC |
| CTAAAAAAAAAAAAA | ATTGCAGGCACGCGC | TGATCAATAAATACT |
| CCGTGTTGGCCGGGC | TCACGTGTTTATCTG | AGTGCCGAGATTGCA |
| AATAAAAAAAATTAA | AAGAGGTAGACATGG | AGGCCGCAGGGACCT |
| GCCAGCCTCGGCCTC | TTAAGTACCCAGGGA | CCTCTGCCTAGGAAA |
| GGCCACCACCCCGTC | CGGGCTCCAGTGATT | GCCCCTCTGCCCGGC |
| ATGATGACAATGGCG | GGGATGTGGGGAGCG | TCTGGGAGGTGAGGG |
| CTAATCTTAAGTACC | GGGATGTGGGGAGCA | TCATTTTGTTCTGTA |
| ATGCCGAGCCGAGGC | AGACTTCATTTTGTT | CGCCTCGGCCTCCCG |
| CTCGCTACAACCTCC | GTATTTTTTGGTGG | TAAGGGCGGTGCAAG |
| TGATGCCGAGCCAAA | ATCGTCTGGGATGTG | CCAAGAATGATCAAT |
| CACGCCTGACTGGTT | GCGCCTCTTCCCGGC | GACCGGGCTGGTCTC |
| GGAAAAGATTGAGAA | ACAAACACTGCGGAA | GCTGTTAATCTATAA |
| CTGCCTTGGCCTCCC | CCCATCGTCTGAGAT | CTTCTGGGAAGTGAG |
| GCTGACCTTCTCTCC | GAGACTTCATTTGT | AGAAAGGCGGGAAAG |
| GCCCAGGCTGGAGTG | TTAAGAGTCATCACC | AGTCTCGCTCACTCA |
| GTTTCGCTGTGTTGA | GGGCGCCTCTGCCCG | GTCTAGGAAGTGAGG |
| CTCCATTTTGTTCTG | CTCACTGCAACCTCC | TGGGATTGCAGACGG |
| GTTTCGCTGTGTTGG | ATCGTCTGAGATGTG | AGAGTCATCACCACT |
| CTCTCCACTATTATC | CCGGCCGCCCAGTCT | GATGCTGTTGATCTG |
| GTCTGTGTGGATAGA | TGAGATGTGGGGAGC | CCCCGCCGCCCCGTC |
| TTTCGTATTTTTTTG | GCTGCCATCTCGGCT | GGGCCATGATGACGA |
| CTTTGTTCACTTGTT | AGTGGCGTGATCTCG | AAGCTGGACTGTACT |
| ACAACCTACACCTCC | CGCCTGCCTTGGCCT | GCAGACGGAGTCTCG |
| GTGATTCTCCTGCCT | GCTGTGTCCACTCAG | TCTGCCCGGCCGCCA |
| GGTTAAATGGATTAA | CTCTTCCCGGCCGCC | TCTGCCCGGCCGCCC |
| CTGCCAAATCCCCCT | GCCGCCACGCCTGAC | GGATGTGAGGAGCCC |
| CCTAACCGCGAGTGA | TTTTTTTGGTGGAGA | GGGAAGTGAGGAGCG |
| CAACTCAGGGTTAAA | CTCCCTGTCCCCTCT | GGGAAGTGAGGAGCC |

TABLE 1-continued

Library of Antisense Oligonucleotides Targeting SVA

| | | |
|---|---|---|
| AAAGTGCCGAGATTG | TTACCCCCAACCCTG | TCCACCTCCCAGCCG |
| AGAATGATCAATAAA | TGTGGATAGAAGTAG | GTGGGGAAAAGATAG |
| TGACCTTATCCCCAA | CTACAACCACCTCCC | CTAAGATTGCAGCCT |
| TCTGCTGACCTTCTC | GTTTATCTGCTGACC | TGAAGGCAGCATGCT |
| AAAGGCGGGAAAGGT | GGGGATGGGCCATGA | GCTGGACTGTACTGC |
| GGTCTGTGTGGATAG | GACTTCATTTTGTTC | CACTGCGGAAGGCCG |
| ACGGTCTCCCTCTCA | TGGCGGTTTTGTGGA | GAGGAGCGCCTCTTC |
| GTGATCTCGGCTCGC | CCGCCCAGTCTGGGA | TCGAAAAGAAAAGGG |
| GTAGAAAGAGGTAGA | CTCCCAGCCGCCTGC | TTTGTTAAACAGATG |
| TCTGCCTGGCTGCCC | GCTCGCTACAACCAC | CTGACTGGTTTTGGT |
| CGATTGCAGGCGCGC | CACCCCGTCTGGGAA | TTGCAGGCACGCGCC |
| ATTGAGAAATCGGAT | GGGAGCGCCTCTGCC | TCTGTTGCCGAGGCT |
| CGCCTCTGCCCCGCC | GTGGAATAGAAAGGC | AGAGAGATCAGATTG |
| ACCCAGCGACCATTG | TCTCGGCTCACTGCA | CTCGGCCTCCCGAGG |
| AGCGTCTCTGCCCGG | GTGGAATAGAAAGGG | TGGCGTGATCTCGGC |
| CCTAATCTTAAGTAC | GGGAGGAGGTGGGG | GCCTCCGCCCGGCCG |
| AAAGATTGAGAAATC | TTTGTATTTTGGTG | TCTCCCTCTCCCTCT |
| CGAGTGATCCGCCAG | GGTGCCCAGGCTGGA | TCAGGGTTAAATGGA |
| CCATCTAGGAAGTGA | TATTTTTTGGTGGA | CTGTGAGAAACACCC |
| GAAAGAGGTAGACAT | CCGCCTCGGCCTCCC | CCGAGTGCCTGCGAT |
| TTGGCCGGGCCGGTC | TGCCGGGTCTGTGTG | CCCTCCACTATTGTC |
| GGAGACGGGGTTTCG | GAATAGAAAGGGGGG | CCTCTCCCCTCTTTC |
| CCGCGAGTGATCCGC | TCAAGTACCCAGGGA | CAATGGCGGCTTTGT |
| TAGAAAGGGGGGAAA | GGTAGACATGGGAGA | CGCCTCTGCCCGGCC |
| GCCTCTTCCCGGCCG | ACATGTGCTGTGTCC | GAAACATGTGCTGTG |
| AAAGATAGAGAAATC | ACATGTGCTGTGTCA | CCCCCAACCCTGTGC |
| GCCGGTCTCCAGCCC | CGGAGTCTGGTTCAC | GAGTCTCGCTCACTC |
| CGGTTTTGTCGAAAA | CGTATTTTTTGGTG | TGGTGGAGACGGGGT |
| CTTTGTTAAACAGAT | ACCCCCAACCCCGTG | GGTCTCCCTCTGTTG |
| CAGCTCCTAACCGCG | CCTGCCTGATTCTCC | AAACACTGCGGAAGG |
| TTCACTTGTTTATCT | CGTCTGGGAGGTGTG | GGCCGCCATCCCGTC |
| CTCGCTACAACCACC | CGTCTGGGAGGTGTA | CAGACGGAGTCTCGT |
| CCTCCCAGCCGCCTG | TCTGCGAGAAACACC | GCTCATTGGGGATGG |
| TCCCTAATCTCAAGT | TTGAGAACGGGCCAT | CATCACCACTCCCTA |
| CTGCCTGATTCTCCT | CCCCCTCTGCGAGAA | TCTCCCTCTCCCCTC |
| TGCCTGCGATTGCAG | CATTGGGGATGGCC | CAGACGGAGTCTCGC |
| GCTCACTCAGTGCTC | GCGGGAAGGGTGGGG | AAGGGTGGGAAAAA |
| TCTCGGCTCGCTACA | GTACCCAGGGACACA | TTCTGGGAAGTGAGG |
| GCCGCCATCTCGGCT | GCGCCTCTGCCCCGC | CCTGCCACATCCCCC |
| GCTCCTAACCGCGAG | TTTCGCCGTGTTGGC | CTGCCCAGTCTGGGA |
| TAGGAAAACCAGAGA | TGTACTGCCGTGATC | ACCTTACCCCCAACC |
| CTCGCTCACTCAGTG | ACCTCCCTGCCTCGG | CGCCATCCCGTCTGG |
| CCTCTTTCTACGGTC | ATTTTTTGGTGGAGA | CTCTGCCCGGCCGCC |
| TCGCTGCAACCTCCC | CTATGACCCTGCCAC | AGGAGGTGGGGGGT |
| AGCACCTCTGCCCCG | CTTGTTTATCTGCTG | CTCCCGAGGTGCCGG |
| AAGTGAGGAGCGTCT | CTATGACCCTGCCAA | CGAAGCTGGACTGTA |
| AGGGGGAAATGTGGG | TAAAAAAAAAAAAAA | GTTGGCCGGGCTGGT |
| GCCTTGGGATCCTGT | CGCTACAACCTACAC | TAGAAAGGGGGAAA |
| CATCTAGGAAGTGAG | GTCCACTCAGGGTTA | GGCTGGAGTGCAGTG |
| ATCTGTGACCTTATC | GCAGGGTCCTCTGCC | CCCTGCCTCGGGCTC |
| GGGGGGGTCAGCCCC | CCCCTCTTTCCACGG | GTCTGGGATGTGGGG |
| GTGTTTATCTGCTGA | GTCTGGGAGGTGAGG | CTGTGTCAACTCAGG |
| GGAAAACCAGAGACC | TGGGGATGGGCCATG | GCCGTGTTGGCCGGG |
| GCATGCTCGTTAAGA | GGTGTACCCAGCGAC | CACTATTATCCTATG |
| AAAAGATTGAGAAAT | GCTGACCTTCCCTCC | CCCCTCTCCGAGAAA |
| AAGTGAGGAGCGCCT | CCGCGAGTGATCTGC | CGGCTCGCTACAACC |
| ACCTTCTCTCCACTA | CGGCCGCCCCTTCTG | GTCTGGGATGTGAGG |
| AGACTTTTCATTTTG | GATTGAGAAATCGGA | GACATGGGAGACTTT |
| CTCGGCTCGCTACAA | AGTGCCTGGGATTGC | CCCCTCTTTCTACGG |
| CTCCAGCCCCTAACC | CTGAGATGTGGGGAG | GAAGGCCGCAGGGAC |
| AGGTAGACATGGGAG | AGAAGTAGACATGGG | AGGATGACAATGGCG |
| TCCCGAGGTGCTGGG | CGCCCATCGTCTGGG | GACATGGGAGACTTC |
| CCTCGAGTGATCTGC | TGCCCGGCCGCCCAG | CCACCACCCCGTCTG |
| GGTTCACTCAGTGCT | TCAATAAAAAAAAA | GGGAGGTGTGCCCAA |
| CAGCCTCGGCCTCCC | GTCGAATAGAAAGG | GCCCGCCTCGGCCTC |
| AAGGCCGCAGGGTCC | CTCCCTCTCCCCTCT | GGGAGGTGTGCCCAG |
| GTACTAAGAAAAATT | TGCCCGGCCGCCCAT | ATCTGTGACCTTACC |
| AAGATGTGCTTTGTT | TTGAGAACGGGCCAG | TATAACCTTACCCCC |
| AATCCCCTCTGCGA | AGCTGGACGGTACTG | CATGCTCGTTAAGAG |
| TGACCCTGCCACATC | TGTATTTTTGGTGGA | GCGTCTCTGCCTGGC |
| GCCTCTGCCCCGCCG | AAGAATGATCAATAA | GGGTCTGTGTGGATA |
| TGGGATGTGAGGAGC | CTAATCTCAAGTAAT | CGTCCGGGAGGTGAG |
| TTCCACGGTCTCCCT | GATCCTGTTGATCTG | ACGGTCTCCCTCTGT |
| CTGCCTAGGAAAACC | TCGGCTCGCTGCAAC | ATGGTGCCCAGGCTG |
| GGCCGGTCTCCAGCC | CGCCATCTCGGCTCA | TGGGAGGTGTACCCA |
| CCTTATCCCCAACCC | AAGAAGTAGACATAG | TCTGCCCGGCCAGCC |
| CGGCTCACTGCAACC | CTCCAGCTCCTGGCC | CCCTGTCCCCTCTTT |

TABLE 1-continued

Library of Antisense Oligonucleotides Targeting SVA

| | | |
|---|---|---|
| TCTGCCTGGCCGCCC | AAAAGGGGGAAATGT | TGACCTTACCCCCAA |
| TCGTTTTTTTTTGGT | ACTGCGGAAGGCCGC | ACGGTCTCCCTCTGA |
| CAATGGCGGTTTTGT | CCGTGATCTCGGCTC | CCTTTGTTCACGTGT |
| CGAGAAACACCCAAG | TGTGTCCACTCAGGG | TGTACTGCTGCCATC |
| GTGTTGACCGGGCTG | CGTGTTTATCTGCTG | TGGGATTGCAGGCGC |
| AGACGGAGTCTCGCT | ATTTTTGGTGGAGAC | CCCCTCTGTGAGAAA |
| CCCTGCCAAATCCCC | AGACCTTTGTTCACA | TTTGGTGGAGACGGG |
| CTCCTGACCGCGAGT | AGACCTTTGTTCACG | AACCTCCCTGCCTCG |
| AGGGGGGAAAGGTGG | GGATTGCAGACGGAG | CCTGACTGGTTTTGG |
| CCCGGCCGCCCCTAC | CCCAACCCCGTGCTC | CCACGGTCTCCCTCT |
| TCAGTGCTCAATGTT | AGCTCCTGGCCTCGA | GCGGCTCATTGGGGA |
| GCCGAGGCTGGACTG | TAGAAAGAAGTAGAC | ACTTCATTTTGTTCT |
| TGGCCTCCCAAAGTG | CTCCAGTGATTCTCC | CCTCCCTGCCTCGGG |
| CTCGAGTGATCTGCC | CTGCCCGGCCACCGC | GGGATTGCAGGCACG |
| TCGTTCACTCAGTGC | ATCTCAAGTAATCAG | TGTCCTATGACCCTG |
| CTCCCCTCTCTCCAC | GATGGCGGTTTTGTC | GCCCAGTCTGGGAAG |
| CCAGCGACCATTGAG | GATGGCGGTTTTGTG | CGTCTGGGAGGTGGG |
| CCAGGATGACAATGG | AAGTACCCAGGGACA | TCTTAAGTACCCAGG |
| CTGCTGCCATCTCGG | TCCTGGCCTCGAGTG | AGAAAGAGGTAGACA |
| TCCCATCTAGGAAGT | CGTTAAGAGTCATCA | TGTTGACCGGGCTGG |
| CCATGATGACGATGG | ACAATGGCGGCTTTG | CAGCCGCCTGCCTTG |
| GCAGGGACCTCTGCC | GGATGCTGTTGATCT | ATAAATACTAAAAAA |
| CCCGGCCGCCCCGTC | GTGTAGAAAGAGGTA | CCAACCCCGTGCTCT |
| ATCTTAAGTACCCAG | AAGATTGAGAAATCG | GATCTGCCCGCCTCG |
| CAGCGACCATTGAGA | GTGCTGGGATTGCAG | TTGTTCACGTGTTTA |
| CCGAGTGCCTGGGAT | CTCCACTATTATCCT | TGCGGAAGGCCGCAG |
| AAAAGAAAGAGAGAT | GACCGCGAGTGATCT | GGCGGTTTTGTCGAA |
| AGGCGGGAAAGGTGG | GGCCATGATGACGAT | TCAGATTGTTACTGT |
| CTGTTGCCGAGGCTG | CCCCGCCCGGCCAGC | TGCCCGGCCAGCCGC |
| TGGGAGGAGGTGGGG | CGGTCTCCAGCCCCT | ACTGGTTTTGGTGGA |
| GTCTCCCTCTCATGC | CGTCCGGGAGGAGGT | TGCCTTGGCCTCCCA |
| CCTAATCTCAAGTAC | TACAACCTACACCTC | GAATGATCAATAAAA |
| CCAGTCTGGGAAGTG | GGGAGACTTCATTTT | CAGAGACCTTTGTTC |
| CCTAATCTCAAGTAA | CCGGGAGGTGGGGGG | GAAAGAGAGATCAGA |
| TCCGGGAGGAGGTGG | GGTTTTGTGGAATAG | GAATGATCAATAAAT |
| CGGGTCTGTGTGGAT | GTTTTTTTTTGGTGG | AATTATCAATAAAAA |
| CAACCTCCACCTCCC | CGGGCTGGTCTCCAG | CCGGGATTGCAGACG |
| GGCTTTGTGGAATAG | TCCACTATTGTCCTA | GGTTGCCGTGTCTGT |
| CTGGGATGTGGGGAG | ATTGAGAACGGGCCA | AGACGGAGTCTCGTT |
| CTGGTCTCCAGCTCC | CTTCTCTCCACTATT | TGCTTGAAGGCAGCA |
| TGGGAAGTGAGGAGC | GTGATCCGCCAGCCT | ATAGAAAAGGGGGAA |
| CCCTCTGTTGCCGAG | GCTGGACGGTACTGC | AAAGAGGTAGACATG |
| GTGACCTTACCCCCA | CCCGTCCGGGAGGAG | GTTCACTTGTTTATC |
| CCCAAAGTGCCGAGA | TCTGGGATGTGGGGA | GTGTGCCCAGCGGCT |
| GGATTGCAGCCTCTG | AGAGACCTTTGTTCA | TCGCCGTGTTGGCCG |
| GTGGGGAAAAGATTG | CCCTCTGCCCGGCCG | TCCTGCCTCGGCCTG |
| GTGCAGTGGCGTGAT | GACCTTTGTTCACTT | CGTTCACTCAGTGCT |
| TAAGAAAAATTCTTC | CCCTCTGCCCGGCCA | GGGTCAGCCCCCCGC |
| TCTGGGAAGTGAGGA | TGCCCCGCCGCCCCG | TTGTATTTTTGGTG |
| AGTGCTCAATGGTGC | CCGGCCGCCCCGTCT | TGCCGAGTGCCTGGG |
| GTGCTTTGTTAAACA | GATTGTTACTGTGTC | TTGGGGATGGGCCAT |
| ATCCCATCTAGGAAG | TGGGATGTGGGGAGC | AAAAAATTAAAAAAA |
| CTGCCCCGCCGCCCC | ACCTCACCTCCCAG | TTTTGTGGAATAGAA |
| GCCTCGGCCTGCCGA | TGGTTTTCGTTTTTT | GGGGGTCAGCCCCC |
| CCTGCCAAATCCCCC | CCGGCCACCGCCCCG | CCTGCCTCGGCCTGC |
| CTCCCTAATCTCAAG | AATGATCAATAAAAA | ATGCCGAGCCAAAGC |
| CCCAAAGTGCTAAGA | ACCCCGTGCTCTCTG | CCTGACCGCGAGTGA |
| GCCCCGCCGCCCCGT | GAGTCTCGTTCACTC | CTATAACCTTACCCC |
| ATGGGAGACTTCATT | CACGTGTTTATCTGC | AATCCCCTCTCCGA |
| GTGCCCAGGCTGGAG | CAGGCACGCGCCGCC | CCTCCCGAGGTGCCG |
| GCCCCGTCTGGGAAG | TAGACATGGGAGACT | CAAAGCTGGACGGTA |
| AGCGCCTCCGCCCGG | TTAATCTATAACCTT | GGGAGCACCTCTGCC |
| ATCCGCCAGCCTCGG | TCTCCACTATTATCC | CCACGCCTGACTGGT |
| CATGGGAGACTTTTC | GTGTACCCAACAGCT | TGGACTGTACTGCCG |
| GGGTTTCGCCGTGTT | CCAGCTCCTGGCCTC | TACAACCACCTCCCA |
| CCTACTGGGAAGTGA | CCGTCCGGGAGGTGG | GTTTTGTCGAAAAGA |
| ATGTGGGGAAAAGAA | CCGTCCGGGAGGTGA | TCTGTGTAGAAAGAG |
| ATGGGCCATGATGAC | CCATCTCGGCTCACT | ATAGAGAAATCGGAT |
| GCCGCCACCCCGTCT | CCCCCCGCCCGGCCA | TCTGTGTAGAAAGAA |
| GGCACGCGCCGCCAC | TTGTCCTATGACCCT | GAGCGCCTCTGCCCG |
| TGTGAGGAGCGCCTC | CGGTCTCCCTCTGAT | ACCTTTGTTCACTTG |
| ACCGCGAGTGATCCG | ATTCTCCTGCCTCGG | GAGCGCCTCTGCCCC |
| GCTGCAACCTCCCTG | GATCTGTGACCTTAC | ATCTCGGCTCGCTAC |
| CCCAAGAATTATCAA | TGCCCGGCCACCGCC | AAAGGCGGGAAGGGT |
| GCCAAATCCCCTCT | ACTAAGAAAAATTCT | GATGTGGGGAGCACC |
| TTCGCTGTGTTGGCC | AAGTGCTAAGATTGC | GGGGTCAGCCCCCCG |
| CTGTGACCTTATCCC | GAGCGTCTCTGCCCG | TATGACCCTGCCACA |

TABLE 1-continued

Library of Antisense Oligonucleotides Targeting SVA

| | | |
|---|---|---|
| GCAACCTCCCTGCCT | GATCTGTGACCTTAT | GCCTCCCAAAGAGCC |
| CGAGGTGCTGGGATT | TGGTTCACTCAGTGC | AGCCTCTGCCCGGCC |
| CGCGAGTGATCCGCC | GACCCTGCCAAATCC | CCAGGGACACAAACA |
| GAAAAGAAAAGGGGG | GATTGCAGCCTCTGC | CCCGGCCGCCATCCC |
| ATTGTTGCTGTGTCT | GACCTCTGCCTAGGA | GAGGAGCGCCTCTGC |
| ACCGCCCCGTCTGGG | CATGATGACGATGGC | TCTCCCTGTCCCCTC |
| TGATCCGCCAGCCTC | GGGATTGCAGACGGA | CCCGTCTGGGATGTG |
| TGATTCTCCTGCCTC | CGGGAGGAGGTGGGG | TCAGCCCCCGCCCG |
| CAGCTCCTGACCGCG | ACCCCGTCTGGGAGG | GGGGAAATGTGGGGA |
| GTGCTCAATGTTGCC | CTCCCTCTCCCTCTC | CCCCTCTGCCCGGCC |
| GAGGAGGTGGGGGGG | CTCTCCACGGTCTCC | ATCTGCTGACCTTCC |
| GCTCCTGACCGCGAG | GGAGTCTCGCTCACT | GGGGAAAGGTGGGGA |
| TGCTCAATGTTGCCC | GGCCTCGAGTGATCT | TGCTCAATGGTGCCC |
| GTGCCCAGCGGCTCA | CCTCTGCCTGGCTGC | TACCCCCAACCCTGT |
| CCTCCCTGCCTGATT | TGCCCGGCCGCCCCT | ATCTGCTGACCTTCT |
| GCCGAGTGCCTGCGA | ATGCCGAGCCGAAGC | TTTGTCGAAAAGAAA |
| TCTGTGACCTTACCC | AAATCCCCTCTGTG | TTCTACGGTCTCCCT |
| ACCTCCCAGCCGCCT | CCTTTGTTCACTTGT | AGATGCTTGAAGGCA |
| AAAATTCTTCTGCCT | TTGTTTATCTGCTGA | CTGGCTGCCCAGTCT |
| AGTCTGGTTCACTCA | ACTGTACTGCCGCCA | CCTCCCAAAGTGCCG |
| TTTGTATTTTTGGT | AAAAAAAAAAAAAA | CTCTGAAACATGTGC |
| ATTGTCCTATGACCC | GCCGCCATCCCATCT | CCAAAGTGCTAAGAT |
| AATCTCAAGTACCCA | TGCCCGGCCGCCCCG | CGGGAGGTGGGGGC |
| TTGCTGTGTCTGTGT | GACCTTTGTTCACGT | ACGGGGTTTCGCCGT |
| CCGCCTGCCTTGGCC | GCCACATCCCCCTCT | GCTCACTGCAACCTC |
| CCGAGGTGCCGGGAT | GTTTTCGTTTTTTTT | GATGCCGAGCCAAAG |
| AAGAGAGATCAGATT | GTCTCTGCCCGGCCG | GTTGCCGTGTCTGTG |
| GCCCGGCCACCACCC | TGGTCTCCAGCTCCT | CCTAGGAAAACCAGA |
| GGGTGGGGAAAAAAT | CAGACGGAGTCTGGT | TGGCGGTTTTGTCGA |
| TCCACGGTCTCCCTC | CCAAAGAGCCGGATT | TCTCCCTCTCTCCA |
| GTCTCCAGCCCCTAA | TGGCTGCCCAGTCTG | CGCGAGTGATCTGCC |
| GCCTGGGATTGCAGG | GAGATCAGATTGTTA | TGTGCTGTGTCAACT |
| CGGGAGGTGAGGGGC | GGGAAATGTGGGGAA | TGTTCACATGTTTAT |
| CCTCCCAAAGAGCCG | CCTCCCAAAGTGCTA | TCTCCCTCTCATGCG |
| TGGACGGTACTGCTG | CCATCGTCTGAGATG | GAGGAGCGCCTCCGC |
| CCCCCTCTGTGAGAA | GGCGCCCATCGTCT | GGGAGGTGGGGGGT |
| GAGGTGCTGGGATTG | GGAGTGCAGTGGCGT | GTGTGGATAGAAGTA |
| GAGTCATCACCACTC | CCCTAACCGCGAGTG | AATAGAAAGGGGGA |
| AAACCAGAGACCTTT | GGTTTTGTCGAAAAG | AAGGCAGCATGCTCG |
| CGGGATTGCAGACGG | TAATCTATAACCTTA | ACCCTGCCACATCCC |
| CCGAAGCTGGACTGT | TACACCTCCCAGCCG | AAGAATTATCAATAA |
| TGACTGGTTTTTGTA | TTGCAGCCTCTGCCC | CCACCTCCCAGCCGC |
| TTTTTTGGTGGAGAC | AGATTGAGAAATCGG | TTGTTCACATGTTTA |
| GGATGGTTGCCGGGT | ATTGTTACTGTGTCT | AGCCCCTCTGCCCGG |
| CGGCCGCCATCCCGT | TTTGTTCACTTGTTT | ACTCCATTTTGTTCT |
| GGAAGTGAGGAGCGC | CTCGCTACAACCTAC | GTTCACTCAGTGCTC |
| CGAGTGCCTGGGATT | ACTGGTTTTCGTTTT | GTCCCTCTTTCCAC |
| TGGCCGCCCATCGTC | CTGCCCGGCCACCAC | AAGGGGGAAATGTGG |
| GAGATGTGGGGAGCG | GCTCCAGTGATTCTC | CCGGGCTGGTCTCCA |
| CCTCTTCCCGGCCGC | CTAAGAAAAATTCTT | CGCCGCCACGCCTGA |
| GCGTGATCTCGGCTC | CCCCCTCTCCGAGAA | CGTCTGGGAGGTGAG |
| GTGCTCAATGGTGCC | CCTCTCTCCACGGTC | TGGTTTTTGTATTTT |
| TGGAATAGAAAGGCG | AATAGAAAGGGGGA | AGTGCAGTGGCGTGA |
| AAAGTGCTAAGATTG | TCTTTCCACGGTCTC | GAGAAACACCCAAGA |
| TTCCCTCCACTATTG | CGTGTCTGTGTAGAA | ACTGGTTTTCGTATT |
| CCTTGGGATCCTGTT | TCCAGCTCCTAACCG | AAGATAGAGAAATCG |
| CGGGGTTTCGCCGTG | TCCTAACCGCGAGTG | CCTGCGATTGCAGGC |
| CCAAGAATTATCAAT | TGACCTTCCCTCCAC | AAGTGCCGAGATTGC |
| CCCAACAGCTCATTG | CAGGGACCTCTGCCT | TGCTGACCTTCCCTC |
| TTTATCTGCTGACCT | TGTTAAACAGATGCT | ATTTTGTTCTGTACT |
| TGCTGTTAATCTATA | CCGTCTGGGAGGTGA | ATGATCAATAAATAC |
| GTGGGAAAAAATTG | AATGATCAATAAATA | CTGCCGCCATCTCGG |
| AGGGGCGCCTCTGCC | CGCCAGCCTCGGCCT | GTCTGGGAGGTGTAC |
| ATAAAAAAATTAAA | TGGTGCCCAGGCTGG | AGGTGTACCCAGCGA |
| CGGGCCAGGATGACA | TGCCTGGCCGCCCAT | TTTTGGTGGAGACGG |
| GAGCCCCTCTGCCCG | AGGAAAACCAGAGAC | TTTTTGTATTTTTGG |
| TCTCCTGCCTCAGCC | CTCGGCTCGCTGCAA | AATCGGATTGTTGCT |
| GCCGCAGGGACCTCT | GAGGTGTGCCCAACA | TTGCCGTGTCTGTGT |
| GTAGACATGGGAGAC | ACGCGCCGCCACGCC | TCTGCCCCGCCGCCC |
| CTCCAGCTCCTGACC | CCGTCTGGGAGGTGT | TCCCAAAGAGCCGGA |
| TGGGATCCTGTTGAT | CTCCTGGCCTCGAGT | CCTACACCTCCCAGC |
| GGATGGTTGCCGTGT | GAGTCTGGTTCACTC | ACGATGGCGGTTTTG |
| CTGGTTTTTGTATTT | CGTCTCTGCCCGCC | CCCGCCTCGGCCTCC |
| AGTGAGGAGCGTCTC | TTCTCCTGCCTCAGC | GGATGTGAGGAGCGC |
| GTCTGGGAGGTGGGG | CCCTGTGCTCTCTGA | CCGGGCCGGTCTCCA |
| AACCCCGTGCTCTCT | CCTCCCGAGGTGCTG | GGCTGCCCAGTCTGG |
| CGTCTGGGAAGTGAG | GTCCCATGACCCTGC | CTGTGTCCACTCAGG |

TABLE 1-continued

| Library of Antisense Oligonucleotides Targeting SVA | | |
|---|---|---|
| TGCCTCAGCCTGCCG | AGAAAGAGAGATCAG | AGTCATCACCACTCC |
| CTTATCCCCAACCCT | CGAGCCGAGGCTGGA | CTGGTTTTGGTGGAG |
| AGGAGCGTCTCTGCC | ATAGAAAGGCGGGAA | GGTGTGCCCAGCGGC |
| TATTGTCCTATGACC | AGCCGCCCCGTCCGG | CGAGCCGAAGCTGGA |
| TCCCCAACCCTGTGC | CGGATTGCAGCCTCT | GGGCTCCAGTGATTC |
| GACTCCATTTTGTTC | TTATCCCCAACCCTG | TCCACTATTATCCTA |
| CACTATTGTCCTATG | AATCTATAACCTTAC | GAAGCTGGACTGTAC |
| GAAGTGAGGAGCGCC | CTACAACCTCCACCT | GGCCGCCCAGTCTGG |
| CGCAGGGACCTCTGC | GTGGGGAGCACCTCT | TGGAGACGGGGTTTC |
| CTTGAAGGCAGCATG | AAATCCCCCTCTGCG | TCACTTGTTTATCTG |
| TTGGTGGAGACGGGG | TGCAGGCGCGCGCCG | CCCTGCCACATCCCC |
| CCCAAAGAGCCGGAT | GATCTCGGCTCGCTG | TCTCCTGCCTCGGCC |
| GCCTGATTCTCCTGC | CAGCCTGCCGAGTGC | TAGGAGACTCCATTT |
| TTTTCATTTTGTTCT | AGATTGCAGCCTCTG | GACGGAGTCTGGTTC |
| GTTACTGTGTCTGTG | TGCCCAGCGGCTCAT | TTGGCCGGGCTGGTC |
| TGACCGCGAGTGATC | AGGTGAGGGGCGCCT | GAAAACCAGAGACCT |
| CTCGTTCACTCAGTG | GATCTCGGCTCGCTA | GATGTGAGGAGCCCC |
| CCGCCATCCCGTCTG | TGCCCGCCTCGGCCT | TAGAAGTAGACATGG |
| TCTCCAGCCCCTAAC | GGGCGGTGCAAGATG | CCCTCTCCCTGTCCC |
| CTCTCCGAGAAACAC | CCCGTCTAGGAAGTG | TGGGATGCTGTTAAT |
| GGATAGAAGTAGACA | AGACATAGGAGACTC | CCCGAGGTGCCGGGA |
| CGGATTGTTGCTGTG | TAATCTTAAGTACCC | CATCCCGTCTGGGAA |
| TGTGCTGTGTCCACT | ACCTCCCTGCCTGAT | TCAATGGTGCCCAGG |
| AGGTGGGGAAAAGAT | TCCGCCAGCCTCGGC | CCGGCCGCCCCTTCT |
| CATGTGCTGTGTCAA | TCCCGTCTGGGAAGT | GACAATGGCGGTTTT |
| TCCACTCAGGGTTAA | GAGGTGCCGGGATTG | ACCATTGAGAACGGG |
| GTGGCGTGATCTCGG | CCTCTGCGAGAAACA | AAAAGAAAAGGGGGA |
| CCCAGCCGCCTGCCT | TGGTTTTCGTATTTT | CAACAGCTCATTGAG |
| TGACCGGGCTGGTCT | CCCCTAACCGCGAGT | GAGAACGGGCCAGGA |
| GAGCCCCTCTGCCTG | AGATGTGCTTTGTTA | CTGACCGCGAGTGAT |
| GGGCCGGTCTCCAGC | AAAAAATTGAGAAAT | ATCAGGGACACAAAC |
| GGCTGGTCTCCAGCT | ATGCGGAGCCGAAGC | CGCCCCTACTGGGAA |
| CCCTACTGGGAAGTG | GCTGTGTTGACCGGG | TGCAGACGGAGTCTC |
| GAGGTGTACCCAACA | TTTCGCTGTGTTGAC | AGGGCGGTGCAAGAT |
| GGATGTGGGGAGCGC | GCTGGGATTGCAGAC | TGTTCACGTGTTTAT |
| CCTTTGTTCACATGT | GATGCCGAGCCGAGG | TGCAGACGGAGTCTG |
| ATGTTGCCCAGGCTG | CGTGATCTCGGCTCG | GAAAAGGGGGAAATG |
| CTTTGTTCACATGTT | TGTGACCTTATCCCC | GCCGCCCATCGTCTG |

TABLE 1-continued

| Library of Antisense Oligonucleotides Targeting SVA | | |
|---|---|---|
| AAAGCTGGACGGTAC | AATGTTGCCCAGGCT | ATGTGCTTTGTTAAA |
| GATGGGCCATGATGA | CTTTCCACGGTCTCC | CTGTGTAGAAAGAAG |
| CTAACCGCGAGTGAT | AGTGCCTGCGATTGC | CGTGTTGGCCGGGCT |
| GCTTTGTTAAACAGA | CCGGTCTCCAGCCCC | GTGTGCCCAACAGCT |
| CCGGCCGCCATCCCA | AGAACGGGCCAGGAT | CAGCCGCCCCGTCCG |
| CCCCAACCCTGTGCT | AGGCTGGAGTGCAGT | TGCCGAGGCTGGACT |
| GTCTCCAGCTCCTGA | GCCGAGCCGAAGCTG | CTAGGAAGTGAGGAG |
| AGCCAAAGCTGGACG | GTGTAGAAAGAAGTA | AAACAGATGCTTGAA |
| GTCTCCAGCTCCTGG | TTTCATTTTGTTCTG | AGTACCCAGGGACAC |
| TGCGATTGCAGGCGC | AGAGCCGGATTGCAG | TCTCCCTCTCCCTGT |
| GAAAAGATAGAGAAA | GGGATGGGCCATGAT | TGTTGGCCGGGCCGG |
| GGTTGCCGGGTCTGT | GCGGCTTTGTGGAAT | GCAGTGGCGTGATCT |
| GCTGGTCTCCAGCTC | TGAGGAGCCCCTCTG | AGCCGGATTGCAGCC |
| GCAGCCTCTGCCCGG | AAATCGGATTGTTGC | GGCCGCAGGGACCTC |
| TTGCAGGCGCGCGCC | TTATCAATAAAAAAA | AAAGAAAAGGGGGAA |
| CCACATCCCCCTCTC | ACACCCAAGAATTAT | ACGGGCCAGGATGAC |
| GGGATGTGAGGAGCG | CACCTCCCAGCCGCC | AGCCTGCCGAGTGCC |
| CTCCGCCCGGCCGCC | GGCCTCCCAAAGTGC | AACACTGCGGAAGGC |
| GGGATGTGAGGAGCC | TGTGCCCAACAGCTC | TGTTTATCTGCTGAC |
| AGACTCCATTTTGTT | GCCCGGCCGCCCCGT | TGTGTAGAAAGAGGT |
| ATCGGATTGTTGCTG | CTCAAGTACCCAGGG | TGCAGTGGCGTGATC |
| GAGGTGGGGGGGTCA | CAGGGTCCTCTGCCT | CGCAGGGTCCTCTGC |
| CCTCTGCCCCGCCGC | CATCCCATCTAGGAA | CACTGCAACCTCCCT |
| CCTCTGTGAGAAACA | TTGGCCTCCCAAAGT | TGTGCTTTGTTAAAC |
| GACCTTTGTTCACAT | TGATGACGATGGCGG | TATGACCCTGCCAAA |
| CTGCCATCTCGGCTC | GGTGCCGGGATTGCA | CTCTGCCCGGCCAGC |
| TGCTGACCTTCTCTC | ATGCTGTTGATCTGT | CCACTATTGTCCCAT |
| CTCTCCCTGTCCCCT | CAATGGTGCCCAGGC | CCACTATTATCCTAT |
| GCCGCCCAGTCTGGG | GGGATTGCAGGCGCG | ATGACAATGGCGGCT |
| CTGCGGAAGGCCGCA | TCCAGCCCCTAACCG | CTGTACTAAGAAAAA |
| CCCGGCCGCCCATCG | TTGGCCTCCCAAAGA | TGTGAGGAGCCCCTC |
| AAAAATTCTTCTGCC | CGGTGCAAGATGTGC | TTCGCCGTGTTGGCC |
| GCCGAGTGCCTGGGA | GCTGTGTCAACTCAG | ATAGAAGTAGACATG |
| CTGCTGACCTTCCCT | CCGCCCGGCCGCCAT | TAATCTCAAGTAATC |
| ACGCCTGACTGGTTT | CCTCTTTCCACGGTC | AAAGAGAGATCAGAT |
| ACCCAACAGCTCATT | GTTTTGTGGAATAGA | TCATCACCACTCCCT |
| GGATTGTTGCTGTGT | AAATCGGATGGTTGC | TGCTGTTGATCTGTG |
| CCCTGCCTGATTCTC | GCTCGCTGCAACCTC | CATCCCCCTCTCCGA |
| TGCCGTGTCTGTGTA | GCTCGTTAAGAGTCA | GAGGAGCCCCTCTGC |

TABLE 1-continued

Library of Antisense Oligonucleotides Targeting SVA

| | | |
|---|---|---|
| GGAAAGGTGGGAAA | ACCCAAGAATTATCA | CTGTACTGCCGCCAT |
| GTGGGGAAAAGAAAG | AGGCTGGACTGTACT | GGTGGAGACGGGGTT |
| TGGGAGACTTCATTT | GGCCACCGCCCCGTC | GTTTTCGTATTTTTT |
| TCTGGGAGGTGTGCC | CGGATGGTTGCCGTG | ACCTCTGCCCCGCCG |
| GGACACAAACACTGC | TACCCAGGGACACAA | ACTGTACTGCTGCCA |
| TGCCTGGCCGCCCAG | GACCTTCCCTCCACT | TGTACCCAACAGCTC |
| ACGGAGTCTCGCTCA | AACCCTGTGCTCTCT | GATGGTTGCCGTGTC |
| GTCTCGCTCACTCAG | CTGCCACATCCCCCT | CAGTGGCGTGATCTC |
| TCAAGTAATCAGGGA | GTTGCCCAGGCTGGA | GTGTCCACTCAGGGT |
| GCGGTTTTGTCGAAT | GTTCTGTACTAAGAA | TAGAAAGAGGTAGAC |
| GCCAAAGCTGGACGG | TTGTCGAAAAGAAAA | CTCGGGCTCCAGTGA |
| CACTCCCTAATCTTA | TCCCCCTCTGCGAGA | GCCCAGCGGCTCATT |
| ACCACTCCCTAATCT | CCTGCCTCAGCCTGC | CAGTGATTCTCCTGC |
| GCGGTTTTGTCGAAA | TTACTGTGTCTGTGT | GCCTCTGCCCGGCCA |
| TTGTGGAATAGAAAG | TGGGAGGTGAGGGGC | TGTGTCAACTCAGGG |
| CCCGTGCTCTCTGAA | CTTCTGCCTTGGGAT | TGTGTCTGTGTAGAA |
| TAGGAAGTGAGGAGC | GACCTTACCCCCAAC | TTGTCCCATGACCCT |
| AAAAATTGAGAAATC | TTCTCCTGCCTCGGC | AAACACCCAAGAATT |
| GCGGAGCCGAAGCTG | CCGCAGGGTCCTCTG | AAGGGGGGAAAGGTG |
| CTCTCATGCGGAGCC | AGGTGCCGGGATTGC | TTTTGTATTTTTGGT |
| GGTGAGGGGCGCCTC | CCCGGCCACCACCCC | TTATCTGCTGACCTT |
| AGGCCGCAGGGTCCT | CATGGGAGACTTCAT | AAGAGCCGGATTGCA |
| GCCACGCCTGACTGG | TGCCTGGCTGCCCAG | AAGTGAGGAGCCCCT |
| CGGCCGCCATCCCAT | TATTATCCTATGACC | CCTGGCCTCGAGTGA |
| TCTCCAGCTCCTGGC | CCTGCCTCGGGCTCC | ACTGCAACCTCCCTG |
| TCCGAGAAACACCCA | GGGGGAAAGGTGGGG | GCCCGGCCACCGCCC |
| CACTCAGGGTTAAAT | CTCCCTGCCTCGGGC | AACTCAGGGTTAAAT |
| CGGCCACCGCCCCGT | CAGCCCCTAACCGCG | CTGGCCGCCCATCGT |
| GTAGACATAGGAGAC | ACCTACACCTCCCAG | CAGGCTGGAGTGCAG |
| AGTGCTAAGATTGCA | AAGGTGGGAAAAGA | TGCCACATCCCCCTC |
| TTCTGCCTTGGGATG | TCCCCTCTCTCCACG | GGCCGGGCCGGTCTC |
| TCCCCTCTTTCCACG | GATGTGGGAGCGCC | CTGACTGGTTTTGT |
| GGGGAAAAGAAAGAG | GACCCTGCCACATCC | AGGGTTAAATGGATT |
| AGATTGTTACTGTGT | AGCGGCTCATTGGGG | TGCCGAGTGCCTGCG |
| TCGCTACAACCTACA | ATCAATAAAAAAAAT | AGTCTGGGAAGTGAG |
| CTCCCAAAGTGCTAA | GCCTTGGCCTCCCAA | TTGTTACTGTGTCTG |
| CCCAGCGACCATTGA | TTAAGGGCGGTGCAA | CGCTGTGTTGACCGG |
| CCTCGGCCTGCCGAG | ATGGCGGCTTTGTGG | ACGTGTTTATCTGCT |

TABLE 1-continued

Library of Antisense Oligonucleotides Targeting SVA

| | | |
|---|---|---|
| CGAGATTGCAGCCTC | AAGGGCGGTGCAAGA | AACATGTCTGTGTC |
| AATACTAAAAAAAAA | GTGCCGAGATTGCAG | GCCATGATGACGATG |
| GCTCCTGGCCTCGAG | GCCTGCCTTGGCCTC | AACGGGCCATGATGA |
| TCGTCTGAGATGTGG | GCCGCCCCGTCCGGG | TGTGCTCTCTGAAAC |
| ATCAATAAATACTAA | CCAAATCCCCCTCTC | AGGAGCGCCTCTTCC |
| GAAGTGAGGAGCGTC | ACCTTTGTTCACATG | CTCTGCCTGGCCGCC |
| GGATTGCAGGCACGC | CCAAATCCCCCTCTG | TCGGATGGTTGCCGG |
| AAATTCTTCTGCCTT | TATCCTATGACCCTG | GGCCGCCACCCCGTC |
| CGCTACAACCACCTC | CTGTGTTGACCGGGC | CTCCTGCCTCAGCCT |
| GGCGGGAAAGGTGGG | GTTTTGTCGAATAGA | GCTCAATGGTGCCCA |
| TCTCTGCCCGGCCGC | GGTCTCCCTCTCATG | AATGTGGGGAAAAGA |
| ATGGCGGTTTTGTCG | GCTAAGATTGCAGCC | CGGATGGTTGCCGGG |
| CAAGAATGATCAATA | TTAAATGGATTAAGG | TTCTGTACTAAGAAA |
| CTGTGACCTTACCCC | TCTGGTTCACTCAGT | AAAGGGGGGAAAGGT |
| TGCAGCCTCTGCCCG | TGCCCGGCCGCCATC | TCTGTACTAAGAAAA |
| AACCTTACCCCCAAC | CGCCCGGCCAGCCGC | CGCCTCTTCCCGGCC |
| TGGAATAGAAAGGGG | CCCTTCTGGGAAGTG | CCACCGCCCCGTCTG |
| AAGTAATCAGGGACA | TCCAGCTCCTGACCG | TGATCTGCCCGCCTC |
| AACCACCTCCCAGCC | TGGGGAGCGCCTCTG | AGTAGACATGGGAGA |
| GTGTCAACTCAGGGT | TCGAGTGATCTGCCC | CATGTGCTGTGTCCA |
| GTGACCTTATCCCCA | GTCCGGGAGGTGAGG | CAACCACCTCCCAGC |
| GGGTTTCGCTGTGTT | GCGATTGCAGGCGCG | CTCTCCCTCTCCCTG |
| CTCCGAGAAACACCC | TTAAACAGATGCTTG | CCGAGCCGAGGCTGG |
| GCCTTGGGATGCTGT | TGTTGCCCAGGCTGG | ACAACCTCCACCTCC |
| GACAATGGCGGCTTT | TCCCGTCTAGGAAGT | CAGGGACACAAACAC |
| TAACCGCGAGTGATC | GGTCTCCCTCTGATG | TCCTGTTGATCTGTG |
| AGACGGGGTTTCGCC | CTGGGATTGCAGGCA | CCCCTCTGCCTGGCC |
| GACTGTACTGCTGCC | CCAAAGCTGGACGGT | GGGAAAAGATAGAGA |
| GGTTTTGTCGAATAG | TGACTGGTTTTCGTT | TCACCACTCCCTAAT |
| TCCTCTGCCTAGGAA | AATCCCCCTCTGTGA | CTGACTGGTTTTCGT |
| GTCTGGGAGGAGGTG | TTTTTTTTGGTGGAG | CCGCCCCTACTGGGA |
| GTCTGGGAGGTGTGC | TGTTAATCTATAACC | CCTATGACCCTGCCA |
| CTCCCTCTGATGCCG | ACCCAGGGACACAAA | AGCCGAGGCTGGACT |
| AGACGGGGTTTCGCT | CGGCCTGCCGAGTGC | CCCCCAACCCCGTGC |
| ACATGTTTATCTGCT | TATTTTTGGTGGAG | CGTCTGGGATGTGAG |
| GAATAGAAAGGGGG | GCCCCTACTGGGAAG | CCTGCCGAGTGCCTG |
| TGGGATGCTGTTGAT | CGTCTGAGATGTGGG | ATCACCACTCCCTAA |
| TGGCCGGGCTGGTCT | TGACTGGTTTTCGTA | AGGCGCGCGCCGCCA |
| TCAATAAAAAAAATT | GTGCCTGGGATTGCA | AGCGCCTCTGCCCCG |

TABLE 1-continued

Library of Antisense Oligonucleotides Targeting SVA

| | | |
|---|---|---|
| GAAATGTGGGGAAAA | TACCCAACAGCTCAT | TTTGTCGAATAGAAA |
| GCTACAACCTCCACC | CGAAAAGAAAAGGGG | GGTGTACCCAACAGC |
| CGCCTGACTGGTTTT | GGCTGGACTGTACTG | TTCACTCAGTGCTCA |
| CTGGGAAGTGAGGAG | CCAACAGCTCATTGA | GACTGGTTTTGGTGG |
| GATCCGCCAGCCTCG | GGGATCCTGTTGATC | GGGACACAAACACTG |
| GTACCCAGCGACCAT | AAAGGGGAAATGTG | TCGAATAGAAAAGGG |
| TCTTCCCGGCCGCCA | CTGTACTGCCGTGAT | GAAATCGGATGGTTG |
| GCGCGCGCCGCCACG | AGGTGTACCCAACAG | GGCCAGCCGCCCCGT |
| CGGCTTTGTGGAATA | CCCGTCCGGGAGGTG | CTGGAGTGCAGTGGC |
| GTCTCCCTCTGTTGC | TCTCGGCTCGCTGCA | AGAAAAATTCTTCTG |
| CTCCCCTCTTTCCAC | AATCTTAAGTACCCA | CACTATTGTCCCATG |
| TCCCAGCCGCCTGCC | CCTCGGCCTCCCGAG | CCGGCCACCACCCCG |
| GCTCTCTGAAACATG | AGACCTTTGTTCACT | CCGCCATCCCATCTA |
| GGGAAAAGATTGAGA | ATGATCAATAAAAAA | TCTGTGAGAAACACC |
| CGCGCGCCGCCACGC | GCCATCCCGTCTAGG | CAATGTTGCCCAGGC |
| CCCTCTGATGCCGAG | ATTTTTTTGGTGGAG | GTCTGTGTAGAAAGA |
| TTGGGATGCTGTTAA | AGAAAAGGGGGAAAT | TGACAATGGCGGCTT |
| TGCCCAGTCTGGGAA | TTTTCGTTTTTTTTT | CCCTCTGCCTGGCCG |
| CACCCAAGAATGATC | ATGTGGGGAGCGCCT | TCCCTGTCCCTCTT |
| CTCCAGCTCCTAACC | TCTCAAGTAATCAGG | CGAGGCTGGACTGTA |
| GGCGGGAAGGGTGGG | GATCAATAAATACTA | TGACAATGGCGGTTT |
| CTGATTCTCCTGCCT | TCTGCTGACCTTCCC | AAAAAAATTAAAAAA |
| AGGCGGGAAGGGTGG | ACTGCCGTGATCTCG | TCTGGGATGTGAGGA |
| CCCCGCCCGGCCAG | AGCTCATTGAGAACG | GGGAAGGGTGGGAA |
| CCTGGCCGCCCAGTC | ATGTGAGGAGCGCCT | AAAAGATAGAGAAAT |
| GTCTGGGAAGTGAGG | TACTGTGTCTGTGTA | TGTACTAAGAAAAAT |
| GTGTACCCAGCGACC | GGGAGGTGTACCCAA | TGCTGTGTCCACTCA |
| GGAAAAGAAAGAGAG | GGGGGGAAAGGTGGG | AAGAGTCATCACCAC |
| CTGCCTGGCCGCCCA | GCCTCGAGTGATCTG | CTCTCCCTCTCTCC |
| TCTGCCCGGCCACCG | TCTTTCTACGGTCTC | ATGTTTATCTGCTGA |
| CGGAGTCTCGCTCAC | GCCCCGTCCGGGAGG | CAAACACTGCGGAAG |
| GCTGTTGATCTGTGA | TCGGCTCGCTACAAC | CATGTTTATCTGCTG |
| TCTGCCCGGCCACCA | GACCTTATCCCCAAC | TGCAGGCACGCGCCG |
| GGGGAGCACCTCTGC | CTGATGCCGAGCCGA | CCGAGAAACACCCAA |
| TGCCGAGCCGAGGCT | TGTGTTGGCCGGGCC | AGGTGTGCCCAGCGG |
| TCCCTCTCCCTCTCC | ACCGGGCTGGTCTCC | CCGTGTCTGTGTAGA |
| AGGCAGCATGCTCGT | CTACGGTCCCTCT | TGTCGAATAGAAAAG |
| GAGTGATCTGCCCGC | GCCATCTCGGCTCAC | CGGGGTTTCGCTGTG |
| GCCCGGCCAGCCGCC | CTACACCTCCCAGCC | GAGTGCCTGCGATTG |
| CGGTACTGCTGCCAT | TTTTTGTATTTTTTG | TACAACCTCCACCTC |
| TCAGCCTGCCGAGTG | TGTGTTGGCCGGGCT | CCTTCCCTCCACTAT |
| CCCTCTTTCTACGGT | CTCTGCCTAGGAAAA | TGGGGAAAAGATTGA |
| TGCCTTGGGATCCTG | GGACGGTACTGCTGC | TCCCTCTGTTGCCGA |
| GAGGGGCGCCTCTGC | CGGGAAGGGTGGGA | GCAGGCACGCGCCGC |
| TCCGCCCGGCCGCCA | CGCCCGGCCGCCATC | TAACCTTACCCCCAA |
| ACCTTCCCTCCACTA | TGCTGTGTCTGTGTA | CCGCCCGGCCAGCCG |
| CTGGGATTGCAGGCG | ATCAATAAAAAAAAA | CTCCCAAAGTGCCGA |
| GTTAATCTATAACCT | GGTCTCCAGCTCCTA | GCCCAACAGCTCATT |
| TGTGGGGAGCACCTC | GCTCATTGAGAACGG | GCCATCCCGTCTGGG |
| GCTGTGTTGGCCGGG | GGTCTCCAGCTCCTG | CCTTCTCTCCACTAT |
| CCCCTTCTGGGAAGT | TCTAGGAAGTGAGGA | CTGCCTCAGCCTGCC |
| CCAGCCCCTAACCGC | GTTAAATGGATTAAG | TCATTGGGGATGGGC |
| AGATGTGGGGAGCGC | GGGGAAAAGATTGAG | CCGCCCCGTCCGGGA |
| TCTCGTTCACTCAGT | CCCTCTCTCCACGGT | AAGGCGGGAAGGTG |
| CTGGACGGTACTGCT | GGAGCGCCTCCGCCC | CGTTTTTTTTTGGTG |
| GGGGGTCAGCCCCCC | AGCCGAAGCTGGACT | CCCCAACCCCGTGCT |
| GAAAGGCGGGAAGGG | CGCCCGTCTGGGAA | GTCTCGTTCACTCAG |
| ATAAAAAAAAAAAAA | AGCGCCTCTGCCCGG | TGGGGAGCACCTCTG |
| GGTTTTGGTGGAGAC | CCAGCCGCCCCGTCC | CTGACCTTCTCTCCA |
| TGCCGAGCCGAAGCT | TGATCAATAAAAAAA | GGCCGCCCCTTCTGG |
| AGAGATCAGATTGTT | CAACCCTGTGCTCTC | GACTGGTTTTCGTTT |
| GAAGTAGACATAGGA | AAGGCGGGAAGGGTG | ATGACGATGGCGGTT |
| GAAGGGTGGGGAAAA | GTACTGCTGCCATCT | AGTGCTCAATGTTGC |
| CAGCGGCTCATTGGG | TGTTGCCGAGGCTGG | TGGATTAAGGGCGGT |
| GGAAGGGTGGGGAAA | CCAGCCGCCCCGTCT | CTGCCTGGCTGCCCA |
| CCCCGTCTGGGAGGA | TGAAACATGTGCTGT | TTTGTGGAATAGAAA |
| CACATCCCCCTCTCC | GAGATTGCAGCCTCT | GTGGGGGGTCAGCC |
| GCCTCCCAAAGTGCT | CAAATCCCCCTCTCC | CTTGGGATGCTGTTG |
| GAGAAATCGGATGGT | GGCGCGCGCCGCCAC | CTTGGGATGCTGTTA |
| GCCCCCCGCCCGGCC | AAGTAGACATGGGAG | AGATCAGATTGTTAC |
| CGACCATTGAGAACG | TCCTATGACCCTGCC | GCCTGGCTGCCCAGT |
| TCCCAAAGTGCCGAG | ATGCTTGAAGGCAGC | TCGGGCTCCAGTGAT |
| CCCCGTCTGGGAGGT | TCCCCCTCTGTGAGA | CTTTGTGGAATAGAA |
| CACCCAAGAATTATC | ATTGCAGACGGAGTC | TAAATGGATTAAGGG |
| GCCTCCCAAAGTGCC | CCTTACCCCCAACCC | TCGGCTCACTGCAAC |
| TCCCTAATCTTAAGT | CTGGACTGTACTGCC | CTCATGCGGAGCCGA |
| CGGGAAAGGTGGGA | GGACCTCTGCCTAGG | GCTACAACCACCTCC |

TABLE 1-continued

Library of Antisense Oligonucleotides Targeting SVA

| | | |
|---|---|---|
| TTCTGCCTTGGGATC | CGCCCCGTCTGGGAG | CTGCCTCGGCCTGCC |
| AGCCCCCCGCCCGGC | CACTTGTTTATCTGC | CGGCCAGCCGCCCCG |
| CCAGGCTGGAGTGCA | CTGCAACCTCCCTGC | TTGATCTGTGACCTT |
| AGAAATCGGATGGTT | TGCGATTGCAGGCAC | AGAAATCGGATTGTT |
| AAAATTGAGAAATCG | CTCTGTTGCCGAGGC | AACACCCAAGAATTA |
| TCTGCCTTGGGATCC | AAGGCCGCAGGGACC | CGCCATCCCGTCTAG |
| GCCTGGCCGCCCATC | TGCCTCGGCCTGCCG | GATGCTTGAAGGCAG |
| GATTAAGGGCGGTGC | GCTCAATGTTGCCCA | GGCTCGCTGCAACCT |
| GCCGCCCCTTCTGGG | CCTCTCCCTCTCCCC | GATAGAGAAATCGGA |
| CAGCCCCCCGCCCGG | GGGAGGTGAGGGGCG | TCCGGGAGGTGGGGG |
| GCGCCGCCACGCCTG | GAGGTGGGGGGCGCC | GAGACGGGGTTTCGC |
| CTGCCCGGCCGCCCA | CAGCCGCCCCGTCTG | TGCCTTGGGATGCTG |
| CCCCTCTGCCTGGCT | ATGTGCTGTGTCCAC | GAGCGCCTCCGCCCG |
| CTGCCCGGCCGCCCC | CCTCTCCCTCTCCCT | CTGGGAGGTGAGGGG |
| CAGGCGCGCGCCGCC | TTCTTCTGCCTTGGG | TGTAGAAAGAGGTAG |
| GCTACAACCTACACC | GGAGACTTTTCATTT | ATCCCCCTCTGCGAG |
| GGTCAGCCCCCCGCC | GGTTTCGCCGTGTTG | GCCATGATGACAATG |
| TGATCTGTGACCTTA | GCCTCGGGCTCCAGT | AATCGGATGGTTGCC |
| TAAGTACCCAGGGAC | AGCTCCTGACCGCGA | TAAAAAAAATTAAAA |
| GTTGACCGGGCTGGT | CTGCGATTGCAGGCA | CCTCTGATGCCGAGC |
| TGGCCGCCCAGTCTG | CTGCGATTGCAGGCG | TTTGTTCACGTGTTT |
| GCGGAAGGCCGCAGG | GCCTGCCGAGTGCCT | GCGCCTCCGCCCGGC |
| TACTGGGAAGTGAGG | TTCCCGGCCGCCATC | CCCGGCCAGCCGCCC |
| TTCGTATTTTTTTGG | CTGGACTGTACTGCT | TCCCCCTCTCCGAGA |
| GGGAAAGGTGGGGAA | CAGATTGTTACTGTG | AAGTAGACATAGGAG |
| CGAGTGCCTGCGATT | TAAATACTAAAAAAA | GACGGAGTCTCGTTC |
| ACCTCTGCCTAGGAA | AGGAGCGCCTCCGCC | TGCCGGGATTGCAGA |
| CGCCACGCCTGACTG | CGCCCCGTCTGGGAT | GGTGCTGGGATTGCA |
| CCTTGGCCTCCCAAA | GGAAATGTGGGGAAA | CTCAGTGCTCAATGT |
| TCAATAAATACTAAA | CTCCACCTCCCAGCC | GTCGAAAAGAAAAGG |
| AAAATTAAAAAAAAA | GTACTGCCGCCATCT | TGGGGAAAAGAAAGA |
| CTCAGTGCTCAATGG | TCTTCTGCCTTGGGA | TGGGGAAAAAATTGA |
| CGTCTCTGCCTGGCC | GTGAGGAGCCCCTCT | TTTTTGGTGGAGACG |
| ACTGCCGCCATCTCG | GAGCACCTCTGCCCC | AATAAAAAAAAAAAA |
| TTGTTGCTGTGTCTG | TTATCCTATGACCCT | AGCATGCTCGTTAAG |
| TCGGATTGTTGCTGT | CTTAAGTACCCAGGG | CGGCCGCCCCTACTG |
| CCTGTTGATCTGTGA | GATGTGAGGAGCGCC | AGAATTATCAATAAA |
| CTTCCCGGCCGCCAT | CCCAGTCTGGGAAGT | TAAACAGATGCTTGA |
| ATAGGAGACTCCATT | GATCAGATTGTTACT | CTGGGATGTGAGGAG |
| GCCACCCCGTCTGGG | CCGCCAGCCTCGGCC | CTTGGCCTCCCAAAG |
| TGTGGAATAGAAAGG | TGTCCCCTCTTTCCA | GACGATGGCGGTTTT |
| CCGCAGGGACCTCTG | ACTTGTTTATCTGCT | TTGTCGAATAGAAAA |
| CGCCTCCGCCCGGCC | CTCTCTGAAACATGT | GCCCGGCCGCCCATC |
| CCCTAATCTCAAGTA | GACGGTACTGCTGCC | CGGAAGGCCGCAGGG |
| AGACATGGGAGACTT | GCACGCGCCGCCACG | CCATGACCCTGCCAA |
| ATCTCAAGTACCCAG | GGAGCGCCTCTTCCC | ACTATTGTCCTATGA |
| ACACTGCGGAAGGCC | CATTTTGTTCTGTAC | CTCTGCCTGGCTGCC |
| TTGCCGGGTCTGTGT | GGAGGTGTGCCCAGC | GTGCAAGATGTGCTT |
| TCGCTGTGTTGACCG | AACCGCGAGTGATCC | GATTGTTGCTGTGTC |
| CCCAGGGACACAAAC | GTACTGCCGTGATCT | CCTCTGCCCGGCCAC |
| CTGCCTTGGGATCCT | CAAGATGTGCTTTGT | CTACAACCTACACCT |
| GGGCCATGATGACAA | CCTCAGCCTGCCGAG | ATCGGATGGTTGCCG |
| TGCCTGGGATTGCAG | TGCAACCTCCCTGCC | CTCTGCCCGGCCACC |
| CTGTGTCTGTGTAGA | CCTCGGGCTCCAGTG | TCTGAAACATGTGCT |
| TCCATTTTGTTCTGT | CCCTCTGCGAGAAAC | CCATCCCATCTAGGA |
| ATGGTTGCCGGGTCT | CAGTGCTCAATGTTG | CCCGGCCGCCCAGTC |
| CGGGAGGTGGGGGGG | GGAGCGTCTCTGCCT | CTGCCCGCCTCGGCC |
| AAATGTGGGGAAAAG | GCCGTGATCTCGGCT | CCGGCCGCCATCCCG |
| CTCGGCCTGCCGAGT | CCTCTGCCCGGCCGC | TCTGGGAGGAGGTGG |
| TGCCATCTCGGCTCA | CATGCGGAGCCGAAG | GCCACCGCCCCGTCT |
| CCAAAGTGCCGAGAT | CTTCATTTTGTTCTG | CTTGGGATCCTGTTG |
| CCGCCCCTTCTGGGA | GAGGTGTGCCCAGCG | TGAGGAGCGTCTCTG |
| GGAAAAGATAGAGAA | GGAGCGTCTCTGCCC | CGCGCCGCCACGCCT |
| GGTGGGGAAAAGATA | TCTATAACCTTACCC | GAAGGCAGCATGCTC |
| TGCTGTGTCAACTCA | GGGTCCTCTGCCTAG | CCGCCATCTCGGCTC |
| CTTTTCATTTTGTTC | ACATGGGAGACTTTT | CAGGGTTAAATGGAT |
| GACATAGGAGACTCC | CTTTCTACGGTCTCC | GGAGGAGGTGGGGGG |
| CCCGTCTGGGAGGTG | ACCCCCAACCCTGTG | CTATTATCCTATGAC |
| GGGAAAAAATTGAGA | TGATGACAATGGCGG | CGCTGTGTTGGCCGG |
| GACTGTACTGCCGCC | TGGGAGGTGGGGGGC | GCTCGCTACAACCTC |
| CCCCGTGCTCTCTGA | CCTCCGCCCGGCCGC | GCTCGCTACAACCTA |
| GATTCTCCTGCCTCG | TGACGATGGCGGTTT | TAGAGAAATCGGATT |
| CCGGCCGCCACCCCG | TCTCCCTCTGTTGCC | TCTGCCCGCCTCGGC |
| GGTGGGGAAAAGATT | CGGCCGCCACCCCGT | AACAGCTCATTGAGA |
| GCCGAAGCTGGACTG | AAAAAAAATTAAAAA | CCGTCTGGGATGTGA |
| ACAGATGCTTGAAGG | AAATGGATTAAGGGC | CTGCCGAGTGCCTGG |
| GGTTTTTGTATTTTT | CATTGAGAACGGGCC | GGTGGGGGGCGCCTC |

TABLE 1-continued

Library of Antisense Oligonucleotides Targeting SVA

| | | |
|---|---|---|
| ATTAAGGGCGGTGCA | GGATGTGGGGAGCAC | CTCTCCCCTCTTTCT |
| GGAGTCTGGTTCACT | TGTGGGAAAAGAAA | GAACGGGCCATGATG |
| GTATTTTTTGGTGGA | CGTCTGGGAGGAGGT | GGAAGGCCGCAGGGT |
| CCGGGAGGAGGTGGG | CATCGTCTGAGATGT | ATCTGCCCGCCTCGG |
| TGGAGTGCAGTGGCG | CGGCCACCACCCCGT | ACATCCCCTCTCCG |
| AAATACTAAAAAAAA | CCCTCTCCGAGAAAC | CTCTCCCCTCTTTCC |
| ATCCCCAACCCTGTG | CCCGGCCACCGCCCC | AGCCGCCCCGTCTGG |
| CCGTCCGGGAGGAGG | GTACCCAACAGCTCA | CAAAGTGCTAAGATT |
| GCCCGGCCGCCCAGT | GGAGTCTCGTTCACT | GGAAGGCCGCAGGGA |
| AGAACGGGCCATGAT | ACACCCAAGAATGAT | CACGGTCTCCCTCTC |
| AGCGCCTCTTCCCGG | TCGTCTGGGATGTGG | ACCTTATCCCCAACC |
| CTTTGTTCACGTGTT | GCGAGAAACACCCAA | GGTGCAAGATGTGCT |
| GGAAAAAATTGAGAA | TCGTCTGGGATGTGA | ACCTTTGTTCACGTG |
| TGTACTGCCGCCATC | TCTCCCTCTGATGCC | TGTCCACTCAGGGTT |
| AGCCGCCTGCCTTGG | GGAAGTGAGGAGCGT | GCCGCAGGGTCCTCT |
| AAAGAAAGAGAGATC | CTCAATGTTGCCCAG | CCGGCCGCCCCTACT |
| GCGTCTCTGCCCGGC | CCTGGCCGCCCATCG | TGGGAGGTGTGCCCA |
| TGGATAGAAGTAGAC | GAAAAAATTGAGAAA | GCGCGCCGCCACGCC |
| ATGTGGGGAGCACCT | ATGGGAGACTTTTCA | CCTGGCTGCCCAGTC |
| GACACAAACACTGCG | AGCCCTAACCGCGA | CTGGGAGGAGGTGGG |
| TCCAGCTCCTGGCCT | CATCCCGTCTAGGAA | ATCTAGGAAGTGAGG |
| GGATGACAATGGCGG | TGTTACTGTGTCTGT | GTGCCCAACAGCTCA |
| AATTCTTCTGCCTTG | CGAGTGATCTGCCCG | ACTCAGTGCTCAATG |
| GATCAATAAAAAAAA | GGCCGCCCCGTCTGG | ATGTGCTGTGTCAAC |
| CTAATCTCAAGTACC | CTCCCGAGGTGCTGG | CCGCCCCGTCTGGGA |
| ACAACCACCTCCCAG | GTGTTGGCCGGGCCG | GTCTGGTTCACTCAG |
| GCCCCTAACCGCGAG | CCCAGGCTGGAGTGC | TGTGTAGAAAGAAGT |
| GACTGGTTTTCGTAT | GACCATTGAGAACGG | TTTTTTTTTGGTGGA |
| CGGGCCATGATGACA | TCTCATGCGGAGCCG | AAAGAAGTAGACATA |
| CTCCTGCCTCGGCCT | CACCACCCCGTCTGG | CCATCCCGTCTAGGA |
| CGGGCCATGATGACG | GTGAGGAGCGTCTCT | AAAGAAGTAGACATG |
| CCCTCTCATGCGGAG | AACCAGAGACCTTTG | GCCCGGCCGCCCCTA |
| TAGAAAGGCGGGAAA | CCCCTACTGGGAAGT | GAGAAATCGGATTGT |
| TAGAAAGGCGGGAAG | ACTATTATCCTATGA | CCCTCTCCCTCTTT |
| ATCTCGGCTCACTGC | AGTGAGGAGCGCCTC | GATGTGCTTTGTTAA |
| TCCCGGCCGCCATCC | TTGTTCTGTACTAAG | ATCAGATTGTTACTG |
| GGAGGTGGGGGGGTC | AAATCCCCTCTCCG | GTGAGGGGCGCCTCT |
| GTTGCCGAGGCTGGA | GCTTTGTGGAATAGA | GAAAGAAGTAGACAT |
| CTCGTTAAGAGTCAT | CAGATGCTTGAAGGC | CTGCCTCGGGCTCCA |
| TCTGATGCCGAGCCA | GCTGTGTCTGTGTAG | TATTTTTGGTGGAGA |
| ATGATGACGATGGCG | CTATTGTCCCATGAC | CCGCCCATCGTCTGG |
| TCTGATGCCGAGCCG | TCACTCAGTGCTCAA | CATCTCGGCTCACTG |
| CCTTCTGGGAAGTGA | TGGGGGCGCCTCTG | GACTGGTTTTTGTAT |
| ACTCAGGGTTAAATG | CCGGCCAGCCGCCCC | AAAGGTGGGGAAAAG |
| ATTCTTCTGCCTTGG | CTGGCCGCCCAGTCT | GATGACAATGGCGGC |
| TGCGAGAAACACCCA | AAGAAGTAGACATGG | CTGGGAGGTGTACCC |
| GCCTCCCGAGGTGCT | AAATTAAAAAAAAA | GGAATAGAAAGGGGG |
| TCACATGTTTATCTG | CTGCCCGGCCGCCAC | GAAAAATTCTTCTGC |
| GGATTAAGGGCGGTG | GGAGCCGAAGCTGGA | GATGACAATGGCGGT |
| CCACTCAGGGTTAAA | CCTCTGCCTGGCCGC | CTGCGAGAAACACCC |
| TTGTTAAACAGATGC | GGTCTCCAGCCCCTA | CCTCTCCCCTCTCTC |
| GCCTCCCGAGGTGCC | CTGCCCGGCCGCCAT | ACTTTTCATTTTGTT |
| ATCCCGTCTGGGAAG | AACAGATGCTTGAAG | CTCAGCCTGCCGAGT |
| GGAGGTGTACCCAAC | ATTGTCCCATGACCC | CTCACTCAGTGCTCA |
| TTTCTACGGTCTCCC | GTCCTATGACCCTGC | GCAGACGGAGTCTGG |
| CTGTGTAGAAAGAGG | GAGGCTGGACTGTAC | CTCTGCCCCGCCGCC |
| ACTCCCTAATCTTAA | TCCCTCTCATGCGGA | CACATGTTTATCTGC |
| AACCTCCACCTCCCA | GGGCCAGGATGACAA | GTTTTGGTGGAGACG |
| TTTTGTTCTGTACTA | TTTTGTATTTTTTGG | CTCATTGGGGATGGG |
| TCGGATGGTTGCCGT | GAAAAGATTGAGAAA | ATCCCCCTCTGTGAG |
| CAGCCTCTGCCCGGC | CTCTCCCTCTCCCTC | GCCCGGCCGCCATCC |
| GCCAGCCGCCCCGTC | CGTCTGGGATGTGGG | TGTATTTTTGGTGG |
| GTCAACTCAGGGTTA | GTATTTTGGTGGAG | GGCAGCATGCTCGTT |
| AAGAAAGGGGGAAA | TGCCTCGGGCTCCAG | CCAGCGGCTCATTGG |
| CCCTAATCTTAAGTA | GGCCGGGCTGGTCTC | GGGGGAAATGTGGGG |
| AGTAGACATAGGAGA | AACCTACACCTCCCA | AGGTGGGGGCGCCT |
| GCCGGGCCGGTCTCC | CTCTTTCTACGGTCT | TCGGCCTGCCGAGTG |
| CGGTCTCCCTCTGTT | CCATCCCGTCTGGGA | CGGGCCGGTCTCCAG |
| TACTAAGAAAAATTC | GGGACCTCTGCCTAG | AAGAAAGAGAGATCA |
| GGTTTTCGTATTTTT | CCCATCGTCTGGGAT | CTAGGAAAACCAGAG |
| AGGAAGTGAGGAGCG | CTGATGCCGAGCCAA | CGCCGCCCCGTCTGG |
| CAGTCTGGGAAGTGA | AGTGATCCGCCAGCC | CCCTCTGCCTGGCTG |
| ACATGGGAGACTTCA | TCTCTCCACTATTAT | GGGGCGCCTCTGCCC |
| CACCACTCCCTAATC | GCCATCCCATCTAGG | TGTTCACTTGTTTAT |
| TCGCTACAACCACCT | TTTCGCTGTGTTGGC | CTTCCCTCCACTATT |
| GTCATCACCACTCCC | CCGCCGCCCCGTCTG | ACTAAAAAAAAAAA |
| TGGACTGTACTGCTG | GTTTTTGTATTTTTG | AATGGATTAAGGGCG |

TABLE 1-continued

Library of Antisense Oligonucleotides Targeting SVA

| | | |
|---|---|---|
| GGCCTCCCAAAGAGC | TGTAGAAAGAAGTAG | CTCCCTGCCTGATTC |
| TTCGCTGTGTTGACC | CCGCCACGCCTGACT | GATGCTGTTAATCTA |
| TCGTTAAGAGTCATC | TGCCCAACAGCTCAT | GAAAGGCGGGAAAGG |
| GAAAAGAAAGAGAGA | GATGCCGAGCCGAAG | ACCCCGTCTGGGAAG |
| GGATGGGCCATGATG | TAAGATTGCAGCCTC | CTGGCCTCGAGTGAT |
| CCGAGCCAAAGCTGG | TCGCTACAACCTCCA | CGCCGTGTTGGCCGG |
| CCTCTCCCTGTCCCC | GTTTTTGTATTTTTT | CCCAGCGGCTCATTG |
| TTTGTTCACATGTTT | ATCCTGTTGATCTGT | GTGCTAAGATTGCAG |
| GGCCGCCCCTACTGG | GCCGAGATTGCAGCC | AGGGACACAAACACT |
| CTGCCGAGTGCCTGC | TCAGTGCTCAATGGT | ATGCTCGTTAAGAGT |
| GGCCAGGATGACAAT | ACCCTGCCAAATCCC | AGGTGTGCCCAACAG |
| ACGGGGTTTCGCTGT | TCCACTATTGTCCCA | TTTTGTCGAAAAGAA |
| CATGACCCTGCCAAA | GGACTGTACTGCTGC | CGGCCGCCCAGTCTG |
| GTGAGAAACACCCAA | TGTGTGGATAGAAGT | CTCTGATGCCGAGCC |
| CCTGTGCTCTCTGAA | TCTGGGAGGTGTACC | CCTTGGGATGCTGTT |
| AGTAATCAGGGACAC | TCATTGAGAACGGGC | CTCCCTAATCTTAAG |
| CCAACCCTGTGCTCT | GATGACGATGGCGGT | ATCCCCCTCTCCGAG |
| TGAGAAATCGGATGG | CCTGGGATTGCAGGC | GCCTGGCCGCCCAGT |
| CCACTCCCTAATCTT | ACGGAGTCTCGTTCA | TTGAGAAATCGGATG |
| TGCTTTGTTAAACAG | GCAGGCGCGCGCCGC | AGAAAGAAGTAGACA |
| TCAATGTTGCCCAGG | GAGCGCCTCTTCCCG | GCCCGGCCGCCACCC |
| CCCCTCTCTCCACGG | CCTCTGCCCGGCCAG | CCCGAGGTGCTGGGA |
| CCTCTCATGCGGAGC | CCAGCCGCCTGCCTT | GGGGGGCGCCTCTGC |
| TGGCCTCGAGTGATC | GGAGGTGTGCCCAAC | GTGGATAGAAGTAGA |
| CAACCCCGTGCTCTC | AAGAAAAATTCTTCT | CCGGCCGCCCATCGT |
| CCACTCCCTAATCTC | TACCCCCAACCCCGT | TCTCAAGTACCCAGG |
| AATAAATACTAAAAA | TTGCAGACGGAGTCT | TTTCGTTTTTTTTTG |
| CGTGCTCTCTGAAAC | GACCTTCTCTCCACT | GTTTCGCCGTGTTGG |
| GCCCCGTCTGGGAGG | ACCACCTCCCAGCCG | CGGCTCGCTGCAACC |
| ATGACCCTGCCAAAT | TCTCCCCTCTTTCCA | CCGTGCTCTCTGAAA |
| TGAGGAGCGCCTCTG | CGTCTAGGAAGTGAG | GCCTGACTGGTTTTG |
| GAGGTGAGGGGCGCC | GCGGTTTTGTGGAAT | GCCTGACTGGTTTTC |
| AATCAGGGACACAAA | CCTGACTGGTTTTCG | GTTAAACAGATGCTT |
| TGAGGAGCGCCTCTT | CCCCGTCTGGGAAGT | GGAGACTCCATTTTG |
| CTGGGATTGCAGACG | TACTGCCGTGATCTC | GCCGGGCTGGTCTCC |
| GCCCATCGTCTGAGA | CGAATAGAAAAGGGG | GCCTGACTGGTTTTT |
| TGCCTAGGAAAACCA | GGGAGACTTTTCATT | AGAAAGGGGGGAAAG |
| CCCATCTAGGAAGTG | TGCCCGGCCGCCACC | GGATGCTGTTAATCT |

TABLE 1-continued

Library of Antisense Oligonucleotides Targeting SVA

| | | |
|---|---|---|
| GAAGGCCGCAGGGTC | ATGGATTAAGGGCGG | TCCAGTGATTCTCCT |
| GGATTGCAGGCGCGC | TACGGTCTCCCTCTG | GAAGTAGACATGGGA |
| CAATAAAAAAAAAAA | CCCGCCCGGCCAGCC | TTCGTTTTTTTTTGG |
| GCTGGAGTGCAGTGG | GGAGACTTCATTTTG | CCCCGTCTGGGATGT |
| GCCCGGCCGCCCCTT | TCTACGGTCTCCCTC | TACTGCTGCCATCTC |
| GGCTCATTGGGGATG | ATTCTCCTGCCTCAG | AGGTGGGGGGGTCAG |
| TGCCGCCATCTCGGC | CGGCCGCCCATCGTC | GATTGCAGACGGAGT |
| AGAGGTAGACATGGG | AGCTGGACTGTACTG | CAGGATGACAATGGC |
| GGCGGCTTTGTGGAA | CCACTATTGTCCTAT | ACTATTGTCCCATGA |
| CAGCTCCTGGCCTCG | ATGCTGTTAATCTAT | AGCTCCTAACCGCGA |
| TCGTATTTTTTTGGT | GCCTCAGCCTGCCGA | CGATTGCAGGCACGC |
| GTGCCTGCGATTGCA | GGGGTTTCGCTGTGT | TCCCTCTCCCCTCTC |
| GAAATCGGATTGTTG | ACCACCCCGTCTGGG | CCATTGAGAACGGGC |
| AATGGCGGCTTTGTG | TCTGCCTAGGAAAAC | GTTCACGTGTTTATC |
| GAAAGGGGGGAAAGG | CGGTTTTGTGGAATA | TCCCTCTCCCCTCTT |
| GCCGAGCCGAGGCTG | GACGGAGTCTCGCTC | GACTGTACTGCCGTG |
| CACTCCCTAATCTCA | CCGCCATCCCGTCTA | ATCCTATGACCCTGC |
| TTGCCGAGGCTGGAC | GAGCCGGATTGCAGC | TTGGGATCCTGTTGA |
| TGTCGAAAAGAAAAG | GCGGTGCAAGATGTG | TCGGCCTCCCGAGGT |
| CGCTGCAACCTCCCT | CATAGGAGACTCCAT | TGTCAACTCAGGGTT |
| GCCTGCGATTGCAGG | CCTCCACCTCCCAGC | CTTACCCCCAACCCT |
| GATAGAAGTAGACAT | AAAGAGCCGGATTGC | TGCTCGTTAAGAGTC |
| CCTGCCTTGGCCTCC | GAACGGGCCAGGATG | AGGGTGGGGAAAAAA |
| TCTCCAGCTCCTAAC | GGTGGGGGGGTCAGC | CTCAATGGTGCCCAG |
| GGCTCACTGCAACCT | GCCCCGTCTGGGATG | TTTCCACGGTCTCCC |
| ATAGAAAGGGGGGAA | CGAGGTGCCGGGATT | GCCGTGTCTGTGTAG |
| GGCCGCCATCCCATC | TCTGTGTGGATAGAA | GGATCCTGTTGATCT |
| TAATCAGGGACACAA | CTCGCTGCAACCTCC | TCCCTGCCTGATTCT |
| CGCTCACTCAGTGCT | GATTCTCCTGCCTCA | CTCCCTCTGTTGCCG |
| AGAAGTAGACATAGG | CTATTGTCCTATGAC | AGGAGCGCCTCTGCC |
| AATGGTGCCCAGGCT | CTCCACGGTCTCCCT | AGAAAGGCGGGAAGG |
| CCCAAGAATGATCAA | GCAGCATGCTCGTTA | GCCGCCCCGTCTGGG |
| TGTGAGAAACACCCA | TCCCTCTCCCTGTCC | CCGTCTGGGAGGTGG |
| CACTCAGTGCTCAAT | CTGTGCTCTCTGAAA | CCGTCTGGGAAGTGA |
| GTGCTGTGTCCACTC | CCGAGCCGAAGCTGG | GACGGGGTTTCGCTG |
| CCCTCTTTCCACGGT | ACTGTACTGCCGTGA | CAGTGCTCAATGGTG |
| TGCTGCCATCTCGGC | GAGTGCAGTGGCGTG | TCCTGACCGCGAGTG |
| GGGGTTTCGCCGTGT | TGAGAACGGGCCATG | CCTCCACTATTGTCC |
| CGGTTTTGTCGAATA | AGTGAGGAGCCCCTC | TGTCTGTGTAGAAAG |

TABLE 1-continued

Library of Antisense Oligonucleotides Targeting SVA

| | | |
|---|---|---|
| TGATGCCGAGCCGAG | CGGCTCATTGGGGAT | CTGTGTGGATAGAAG |
| TGATGCCGAGCCGAA | TGGTTTTGGTGGAGA | GGAGGTGGGGGCGC |
| CTCAAGTAATCAGGG | CAAATCCCCTCTGC | GCGATTGCAGGCACG |
| AAGCTGGACGGTACT | A

TABLE 1-continued
Library of Antisense Oligonucleotides Targeting SVA

| | | |
|---|---|---|
| CCAGCCTCGGCCTCC | CCCGGCCGCCACCCC | AGACGGAGTCTGGTT |
| ATTGGGGATGGGCCA | AATCTCAAGTAATCA | ACCCTGTGCTCTCTG |
| GTTGGCCGGGCCGGT | GGCTCGCTACAACCT | TGGGAGACTTTTCAT |
| GTGCTCTCTGAAACA | AGGCACGCGCCGCCA | TCTCTGAAACATGTG |
| GATTGCAGGCACGCG | CTGTACTGCTGCCAT | GGTACTGCTGCCATC |
| TCGCTGTGTTGGCCG | GGCGGTGCAAGATGT | AAACATGTGCTGTGT |
| ACGGGCCATGATGAC | CTACTGGGAAGTGAG | GGAGCCCCTCTGCCC |
| TATCAATAAAAAAAA | GGGTTAAATGGATTA | AAATTGAGAAATCGG |
| CCATGATGACAATGG | CTCGGCTCACTGCAA | ACACCTCCCAGCCGC |
| TACTGCCGCCATCTC | TTTTCGTATTTTTTT | TGGTTGCCGTGTCTG |
| CGCCCAGTCTGGGAA | TTGTTCACTTGTTTA | CGAGCCAAAGCTGGA |
| TATCTGCTGACCTTC | CACCGCCCCGTCTGG | CGGAGCCGAAGCTGG |
| GCCCCTTCTGGGAAG | TGCCGAGCCAAAGCT | GCCCCTCTGCCTGGC |
| CTCATTGAGAACGGG | TCGCTCACTCAGTGC | GCCGGGATTGCAGAC |
| TATTGTCCCATGACC | CAATAAAAAAATTA | GTCTCCCTCTGATGC |
| GCCGGGTCTGTGTGG | TCCCCTCTTTCTACG | GTAATCAGGGACACA |
| AGTGATCTGCCCGCC | ATGACCCTGCCACAT | GTGGGGAGCGCCTCT |
| GATGGTTGCCGGGTC | CCGCCACCCCGTCTG | GCGAGTGATCTGCCC |
| TTACCCCCAACCCCG | GGGCTGGTCTCCAGC | CCGTCTAGGAAGTGA |
| CGCCCCGTCCGGGAG | TGCCAAATCCCCCTC | GTTGCCGGGTCTGTG |
| CCACCCCGTCTGGGA | ACTCCCTAATCTCAA | GAGAACGGGCCATGA |
| TGGGAGGTGGGGGGG | CGCCCATCGTCTGAG | GTTGATCTGTGACCT |
| GTCTCCAGCTCCTAA | | |
| AAGATTGCAGCCTCT | | |
| GTGCCGGGATTGCAG | | |
| ATAACCTTACCCCCA | | |
| GTTAAGAGTCATCAC | | |
| GAAGTGAGGAGCCCC | | |
| GTGTCTGTGTAGAAA | | |
| GGGGAGCGCCTCTGC | | |
| TTGACCGGGCTGGTC | | |
| GGTGGGGAAAAAATT | | |
| GTCCGGGAGGTGGGG | | |
| GGGGGCGCCTCTGCC | | |
| CGCTACAACCTCCAC | | |
| GGGGAAAAGATAGAG | | |
| AACACCCAAGAATGA | | |
| CTGTTAATCTATAAC | | |
| TGTGTTGACCGGGCT | | |
| ACCGCGAGTGATCTG | | |
| TGGGGGGGTCAGCCC | | |
| TCCCAAAGTGCTAAG | | |
| CTCAGGGTTAAATGG | | |
| TGGCCGGGCCGGTCT | | |
| TCCTGCCTCAGCCTG | | |
| GTCTCTGCCTGGCCG | | |
| TCACTGCAACCTCCC | | |
| GGAGCCCCTCTGCCT | | |

AONS targeting an ALU present in a mammalian genome can be generated using no more than routine methods.

By "agent" is meant a peptide, nucleic acid molecule, or small compound. In one embodiment, the agent is an inhibitory nucleic acid molecule, such as an antisense oligonucleotide.

By "ameliorate" is meant decrease, suppress, attenuate, diminish, arrest, or stabilize the development or progression of a disease. In one embodiment, the disease affects the central nervous system and is associated with the insertion of a transposable element into a mammalian genome.

By "alteration" is meant a change (increase or decrease) in the sequence, expression levels or activity of a gene or polypeptide as detected by standard art known methods such as those described herein. As used herein, an alteration includes a 10% change in expression levels, preferably a 25% change, more preferably a 40% change, and most preferably a 50% or greater change in expression levels."

By "analog" is meant a molecule that is not identical, but has analogous functional or structural features. For example, a polypeptide analog retains the biological activity of a corresponding naturally-occurring polypeptide, while having certain biochemical modifications that enhance the analog's function relative to a naturally occurring polypeptide. Such biochemical modifications could increase the analog's protease resistance, membrane permeability, or half-life, without altering, for example, ligand binding. An analog may include an unnatural amino acid.

In this disclosure, "comprises," "comprising," "containing" and "having" and the like can have the meaning ascribed to them in U.S. Patent law and can mean "includes," "including," and the like; "consisting essentially of" or "consists essentially" likewise has the meaning ascribed in U.S. Patent law and the term is open-ended, allowing for the presence of more than that which is recited so long as basic or novel characteristics of that which is recited is not changed by the presence of more than that which is recited, but excludes prior art embodiments.

"Detect" refers to identifying the presence, absence or amount of the analyte to be detected.

By "detectable label" is meant a composition that when linked to a molecule of interest renders the latter detectable, via spectroscopic, photochemical, biochemical, immunochemical, or chemical means. For example, useful labels include radioactive isotopes, magnetic beads, metallic beads, colloidal particles, fluorescent dyes, electron-dense reagents, enzymes (for example, as commonly used in an ELISA), biotin, digoxigenin, or haptens.

By "disease" is meant any condition or disorder that damages or interferes with the normal function of a cell, tissue, or organ. Examples of diseases include Batten disease or any genetic disorder associated with a heterozygous mutation in a first allele of a gene and the insertion of a transposable element affecting a second allele of the gene.

By "effective amount" is meant the amount of an agent of the invention required to ameliorate the symptoms of a disease relative to an untreated patient. The effective amount of active compound(s) used to practice the present invention for therapeutic treatment of a disease varies depending upon the manner of administration, the age, body weight, and general health of the subject. Ultimately, the attending physician or veterinarian will decide the appropriate amount and dosage regimen. Such amount is referred to as an "effective" amount.

The invention provides a number of targets that are useful for the development of highly specific drugs to treat or a disorder characterized by the methods delineated herein. In addition, the methods of the invention provide a facile means to identify therapies that are safe for use in subjects. In addition, the methods of the invention provide a route for analyzing virtually any number of compounds for effects on a disease described herein with high-volume throughput, high sensitivity, and low complexity.

By "fragment" is meant a portion of a polypeptide or nucleic acid molecule. This portion contains, preferably, at least 10%, 20%, 30%, 40%, 50%, 60%, 70%, 80%, or 90% of the entire length of the reference nucleic acid molecule or polypeptide. A fragment may contain 10, 20, 30, 40, 50, 60, 70, 80, 90, or 100, 200, 300, 400, 500, 600, 700, 800, 900, or 1000 nucleotides or amino acids.

"Hybridization" means hydrogen bonding, which may be Watson-Crick, Hoogsteen or reversed Hoogsteen hydrogen bonding, between complementary nucleobases. For example, adenine and thymine are complementary nucleobases that pair through the formation of hydrogen bonds.

By "inhibitory nucleic acid" is meant a double-stranded RNA, siRNA, shRNA, or antisense RNA, or a portion thereof, or a mimetic thereof, that when administered to a mammalian cell results in a decrease (e.g., by 10%, 25%, 50%, 75%, or even 90-100%) in the expression of a target gene. Typically, a nucleic acid inhibitor comprises at least a portion of a target nucleic acid molecule, or an ortholog thereof, or comprises at least a portion of the complementary strand of a target nucleic acid molecule. For example, an inhibitory nucleic acid molecule comprises at least a portion of any or all of the nucleic acids delineated herein. In one embodiment, an antisense RNA comprises at least about 5, 10, 11, 12, 13, 14, 15, 16, 17, 18, 19, 20, 21, 22, 23, 24, 25, 26, 27, 28, 29, 30, 35 or more nucleobases complementary to a target sequence. In one embodiment, the oligonucleotide comprises 18-22 nucleobases.

The terms "isolated," "purified," or "biologically pure" refer to material that is free to varying degrees from components which normally accompany it as found in its native state. "Isolate" denotes a degree of separation from original source or surroundings. "Purify" denotes a degree of separation that is higher than isolation. A "purified" or "biologically pure" protein is sufficiently free of other materials such that any impurities do not materially affect the biological properties of the protein or cause other adverse consequences. That is, a nucleic acid or peptide of this invention is purified if it is substantially free of cellular material, viral material, or culture medium when produced by recombinant DNA techniques, or chemical precursors or other chemicals when chemically synthesized. Purity and homogeneity are typically determined using analytical chemistry techniques, for example, polyacrylamide gel electrophoresis or high performance liquid chromatography. The term "purified" can denote that a nucleic acid or protein gives rise to essentially one band in an electrophoretic gel. For a protein that can be subjected to modifications, for example, phosphorylation or glycosylation, different modifications may give rise to different isolated proteins, which can be separately purified.

By "isolated polynucleotide" is meant a nucleic acid (e.g., a DNA) that is free of the genes which, in the naturally-occurring genome of the organism from which the nucleic acid molecule of the invention is derived, flank the gene. The term therefore includes, for example, a recombinant DNA that is incorporated into a vector; into an autonomously replicating plasmid or virus; or into the genomic DNA of a prokaryote or eukaryote; or that exists as a separate molecule (for example, a cDNA or a genomic or cDNA fragment produced by PCR or restriction endonuclease digestion) independent of other sequences. In addition, the term includes an RNA molecule that is transcribed from a DNA molecule, as well as a recombinant DNA that is part of a hybrid gene encoding additional polypeptide sequence.

By an "isolated polypeptide" is meant a polypeptide of the invention that has been separated from components that naturally accompany it. Typically, the polypeptide is isolated when it is at least 60%, by weight, free from the proteins and naturally-occurring organic molecules with which it is naturally associated. Preferably, the preparation is at least 75%, more preferably at least 90%, and most preferably at least 99%, by weight, a polypeptide of the invention. An isolated polypeptide of the invention may be obtained, for example, by extraction from a natural source, by expression of a recombinant nucleic acid encoding such a polypeptide; or by chemically synthesizing the protein. Purity can be measured by any appropriate method, for example, column chromatography, polyacrylamide gel electrophoresis, or by HPLC analysis.

By "marker" is meant any protein or polynucleotide having an alteration in expression level or activity that is associated with a disease or disorder.

As used herein, "obtaining" as in "obtaining an agent" includes synthesizing, purchasing, or otherwise acquiring the agent.

"Anti-sense oligonucleotide set" means a number of oligonucleotides that may be used, for example, in a therapeutic composition. A set of anti-sense oligonucleotide set would comprise at least 2, 3, 4, 5, 6, 7, 8, 9, 10, 11, 12, 13, 14, 15, 16, 18, 20, 30, 40, 50, 60, 80, 100, 200, 250, 300, 400, 500, 600, 700, 800, 900, 1000, 1500, 2000, or more AONs.

By "reduces" is meant a negative alteration of at least 10%, 25%, 50%, 75%, or 100%.

By "reference" is meant a standard or control condition.

A "reference sequence" is a defined sequence used as a basis for sequence comparison. A reference sequence may be a subset of or the entirety of a specified sequence; for example, a segment of a full-length cDNA or gene sequence, or the complete cDNA or gene sequence. For polypeptides, the length of the reference polypeptide sequence will generally be at least about 10, 15 or 16 amino acids, at least about 20 amino acids, more preferably at least about 25 amino acids, and even more about 35 amino acids, about 50 amino acids, or about 100 amino acids. For nucleic acids, the length of the reference nucleic acid sequence will generally be at least about 5, 10, 15, 20, or 50 nucleotides, at least about 60 nucleotides, more preferably at least about 75 nucleotides, and even more preferably about 100 nucleotides or about 300 nucleotides or any integer thereabout or therebetween.

By "siRNA" is meant a double stranded RNA. Optimally, an siRNA is 18, 19, 20, 21, 22, 23 or 24 nucleotides in length and has a 2 base overhang at its 3' end. These dsRNAs can be introduced to an individual cell or to a whole animal; for example, they may be introduced systemically via the bloodstream. Such siRNAs are used to downregulate mRNA levels or promoter activity.

By "specifically binds" is meant a polynucleotide that recognizes and binds a complementary sequence of the invention, but which does not substantially recognize and bind other molecules in a sample, for example, a biological sample, which naturally includes other polynucleotide sequences. An antisense oligonucleotide may specifically bind its perfect complement or a sequence to which it is not perfectly complementary. In one embodiment, the antisense oligonucleotide specifically binds a polynucleotide that comprises 1, 2, 3, 4, 5 or more bases that are not perfectly complementary to the anti-sense oligonucleotide.

Nucleic acid molecules useful in the methods of the invention include any nucleic acid molecule that encodes a polypeptide of the invention or a fragment thereof. Such nucleic acid molecules need not be 100% identical with an endogenous nucleic acid sequence, but will typically exhibit substantial identity. Polynucleotides having "substantial identity" to an endogenous sequence are typically capable of hybridizing with at least one strand of a double-stranded nucleic acid molecule. Nucleic acid molecules useful in the methods of the invention include any nucleic acid molecule that encodes a polypeptide of the invention or a fragment thereof. Such nucleic acid molecules need not be 100% identical with an endogenous nucleic acid sequence, but will typically exhibit substantial identity. Polynucleotides having "substantial identity" to an endogenous sequence are typically capable of hybridizing with at least one strand of a double-stranded nucleic acid molecule. By "hybridize" is meant pair to form a double-stranded molecule between complementary polynucleotide sequences (e.g., a gene described herein), or portions thereof, under various conditions of stringency. (See, e.g., Wahl, G. M. and S. L. Berger (1987) Methods Enzymol. 152:399; Kimmel, A. R. (1987) Methods Enzymol. 152:507).

For example, stringent salt concentration will ordinarily be less than about 750 mM NaCl and 75 mM trisodium citrate, preferably less than about 500 mM NaCl and 50 mM trisodium citrate, and more preferably less than about 250 mM NaCl and 25 mM trisodium citrate. Low stringency hybridization can be obtained in the absence of organic solvent, e.g., formamide, while high stringency hybridization can be obtained in the presence of at least about 35% formamide, and more preferably at least about 50% formamide. Stringent temperature conditions will ordinarily include temperatures of at least about 30° C., more preferably of at least about 37° C., and most preferably of at least about 42° C. Varying additional parameters, such as hybridization time, the concentration of detergent, e.g., sodium dodecyl sulfate (SDS), and the inclusion or exclusion of carrier DNA, are well known to those skilled in the art. Various levels of stringency are accomplished by combining these various conditions as needed. In a preferred embodiment, hybridization will occur at 30° C. in 750 mM NaCl, 75 mM trisodium citrate, and 1% SDS. In a more preferred embodiment, hybridization will occur at 37° C. in 500 mM NaCl, 50 mM trisodium citrate, 1% SDS, 35% formamide, and 100 .mu.g/ml denatured salmon sperm DNA (ssDNA). In a most preferred embodiment, hybridization will occur at 42° C. in 250 mM NaCl, 25 mM trisodium citrate, 1% SDS, 50% formamide, and 200 µg/ml ssDNA. Useful variations on these conditions will be readily apparent to those skilled in the art.

For most applications, washing steps that follow hybridization will also vary in stringency. Wash stringency conditions can be defined by salt concentration and by temperature. As above, wash stringency can be increased by decreasing salt concentration or by increasing temperature. For example, stringent salt concentration for the wash steps will preferably be less than about 30 mM NaCl and 3 mM trisodium citrate, and most preferably less than about 15 mM NaCl and 1.5 mM trisodium citrate. Stringent temperature conditions for the wash steps will ordinarily include a temperature of at least about 25° C., more preferably of at least about 42° C., and even more preferably of at least about 68° C. In a preferred embodiment, wash steps will occur at 25° C. in 30 mM NaCl, 3 mM trisodium citrate, and 0.1% SDS. In a more preferred embodiment, wash steps will occur at 42 C in 15 mM NaCl, 1.5 mM trisodium citrate, and 0.1% SDS. In a more preferred embodiment, wash steps will occur at 68° C. in 15 mM NaCl, 1.5 mM trisodium citrate, and 0.1% SDS. Additional variations on these conditions will be readily apparent to those skilled in the art. Hybridization techniques are well known to those skilled in the art and are described, for example, in Benton and Davis (Science 196: 180, 1977); Grunstein and Hogness (Proc. Natl. Acad. Sci., USA 72:3961, 1975); Ausubel et al. (Current Protocols in Molecular Biology, Wiley Interscience, New York, 2001); Berger and Kimmel (Guide to Molecular Cloning Techniques, 1987, Academic Press, New York); and Sambrook et al., Molecular Cloning: A Laboratory Manual, Cold Spring Harbor Laboratory Press, New York.

By "substantially identical" is meant a polypeptide or nucleic acid molecule exhibiting at least 50% identity to a reference amino acid sequence (for example, any one of the amino acid sequences described herein) or nucleic acid sequence (for example, any one of the nucleic acid sequences described herein). Preferably, such a sequence is at least 60%, more preferably 80% or 85%, and more preferably 90%, 95% or even 99% identical at the amino acid level or nucleic acid to the sequence used for comparison.

Sequence identity is typically measured using sequence analysis software (for example, Sequence Analysis Software Package of the Genetics Computer Group, University of Wisconsin Biotechnology Center, 1710 University Avenue, Madison, Wis. 53705, BLAST, BESTFIT, GAP, or PILEUP/PRETTYBOX programs). Such software matches identical or similar sequences by assigning degrees of homology to various substitutions, deletions, and/or other modifications. Conservative substitutions typically include substitutions within the following groups: glycine, alanine; valine, isoleucine, leucine; aspartic acid, glutamic acid, asparagine, glutamine; serine, threonine; lysine, arginine; and phenylalanine, tyrosine. In an exemplary approach to determining the degree of identity, a BLAST program may be used, with a probability score between $e^{-3}$ and $e^{-100}$ indicating a closely related sequence.

By "subject" is meant a mammal, including, but not limited to, a human or non-human mammal, such as a bovine, equine, canine, ovine, or feline.

Ranges provided herein are understood to be shorthand for all of the values within the range. For example, a range of 1 to 50 is understood to include any number, combination of numbers, or sub-range from the group consisting 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50.

As used herein, the terms "treat," "treating," "treatment," and the like refer to reducing or ameliorating a disorder and/or symptoms associated therewith. It will be appreciated that, although not precluded, treating a disorder or condition does not require that the disorder, condition or symptoms associated therewith be completely eliminated.

Unless specifically stated or obvious from context, as used herein, the term "or" is understood to be inclusive. Unless specifically stated or obvious from context, as used herein, the terms "a", "an", and "the" are understood to be singular or plural.

Unless specifically stated or obvious from context, as used herein, the term "about" is understood as within a range of normal tolerance in the art, for example within 2 standard deviations of the mean. About can be understood as within 10%, 9%, 8%, 7%, 6%, 5%, 4%, 3%, 2%, 1%, 0.5%, 0.1%, 0.05%, or 0.01% of the stated value. Unless otherwise clear from context, all numerical values provided herein are modified by the term about.

The recitation of a listing of chemical groups in any definition of a variable herein includes definitions of that variable as any single group or combination of listed groups. The recitation of an embodiment for a variable or aspect herein includes that embodiment as any single embodiment or in combination with any other embodiments or portions thereof.

Any compositions or methods provided herein can be combined with one or more of any of the other compositions and methods provided herein.

BRIEF DESCRIPTION OF THE DRAWINGS

FIG. 5I discloses SEQ ID NOS: 2604-2606, 2611, 2604, 2607, 2606, 2608, 2607 and 2609, respectively, in order of appearance.

FIG. 6A shows the location and chemistry of antisense oligonucleotides that were designed to block the splice acceptor site or exonic splice enhancer (ESE) elements. The ESE elements were predicted by RESCUE-ESE and ESE-finder.

FIG. 6B is a graph showing fold change in the ratio of the normal exon6-exon7 splicing to the abnormal exon6-i6 splicing in response to antisense oligonucleotide transfection, measured by multiplex RT-PCR followed by gel electrophoresis band quantitation. Asterisks indicate statistically significant (P<0.05) difference from the no transfection ("Cell") control.

FIG. 6C shows an example gel image used to obtain the results for panel B. "Ratio" indicates the ratio of the normal exon6-exon7 splicing to the abnormal exon6-i6 splicing, measured by gel band quantitation.

FIG. 8A shows the ratio of the normal exon6-exon7 splicing to the abnormal exon6-i6 splicing in response to antisense oligonucleotide transfection into the subject-derived fibroblast, measured by multiplex qRT-PCR. FIG. 8B is the same as FIG. 8A, but for the subject-derived lymphoblasts.

FIG. 12 is a table that provides a genomic alignment analysis showing that milasen/TY777 has less predicted off-targets than nusinersen. All possible subsequences of a given length were taken from the milasen/TY777 sequence and aligned to the reference human genome by using BLAST. The number and identity of the off-target matches are shown.

FIG. 13 includes lysosomal function assays showing that the subject-derived fibroblasts have abnormal lysosomal function and milasen/TY777 effectively restores the dysfunction.

DETAILED DESCRIPTION OF THE INVENTION

Figure 1:
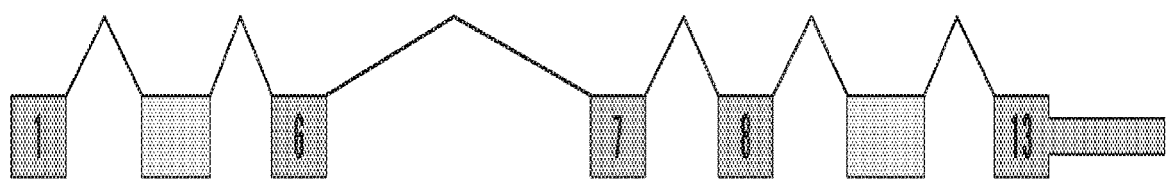
FIG. 1 is a schematic diagram showing the normal intron exon structure of the MFSD8 gene, and the position of the SVA insertion in the proband's MFSD8 gene. MFSD8 is also referred to as CLN7.
Figure 1:
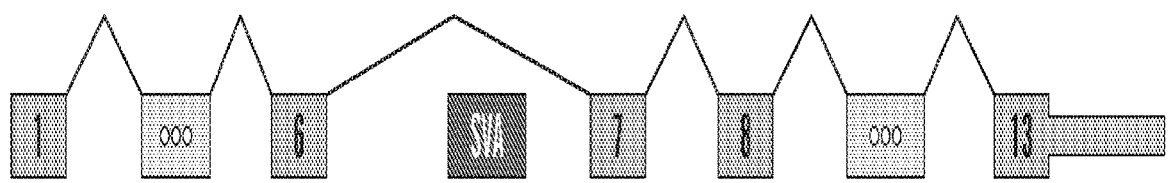

The invention features antisense oligonucleotides and methods of using such antisense oligonucleotide to correct the deleterious effects of transposable element insertion in a mammalian genome.

The invention is based, at least in part, on the discovery of a case of neuronal ceroid lipofuscinosis (NLS) secondary to a cryptic, mobile DNA element (retrotransposon) insertion. Retrotransposon insertions are missed by current clinical sequencing approaches (Sanger, panel, or whole exome sequencing), but can be detected by whole genome sequencing in concert with specialized algorithms that have been developed. Detecting these mutations is of critical importance because they cause disease by serving as "poison exons"—inducing mis-splicing of the normal gene product into the retrotransposon itself, leading to a truncated gene product. The invention provides exon skipping oligonucleotides that can block incorporation of retrotransposon-induced poison exons, thus restoring normal gene function. These oligonucleotides will be used to treat virtually any disease associated with retrotransposon insertion.

Batten Disease Case Study

The impetus for developing oligonucleotides for the treatment of diseases associated with retrotransposon insertion was the identification of a child displaying symptoms of a progressive neurological decline, including worsening gait, language and behavioral regression, and severe loss of vision. Brain and spine MRI identified progressive cerebellar atrophy. Other clinical features include fingerprint inclusions in endothelial cells and sweat ducts. These findings are pathologically consistent with Neuronal Ceroid Lipofuscinosis ("NCL") also termed Batten Disease, which is a rare, recessive disorder resulting in the progressive degeneration of the brain and retina. This degeneration results from the accumulation of ceroid lipofuscin in lysosomes. Symptoms of the disorder include blindness, seizures, and motor and cognitive decline.

Sequence analysis on a biological sample obtained from the child identified the presence of a heterozygous mutation in MFSD8, designated 1102G.C, which is predicted to result in an amino acid substitution (Asp368His). This variant is located at the last nucleotide of an exon and is predicted to result in defective splicing. This variation was associated in the homozygous condition with the presence of NCL. Because Batten disease is recessive, the presence of only a single mutation in an affected individual is entirely unexpected. It begs the question of where the second allele is? Whole genome sequencing was carried out on DNA obtained from the proband. This sequence was compared with sequences obtained from her parents and a sibling. Results of the whole genome sequencing identified the presence of a retrotransposon insertion into the proband's second allele of MFSD8, which introduced a cryptic exon including a stop codon that resulted in truncation of the NIFSD8 protein.

The invention provides one or more antisense oligonucleotides (e.g., a set of antisense oligonucleotides) targeting a deleterious splice acceptor site associated with a retrotransposon insertion, and methods of using the antisense oligonucleotides for the treatment of diseases or disorders associated with a retrotransposon insertion.

Retrotransposons

Retrotransposons make use of an RNA-mediated transposition process. Retroelements are subdivided into two major groups: those containing long-terminal repeats, LTR retroelements, and all others, lumped into the category of non-LTR retroelements. Non-LTR retrotransposons include autonomous and non-autonomous members. The autonomous long interspersed element-1 (LINE-1 or L1), and its non-autonomous partners, SVA and Alu are the only elements currently identified as having retrotranspositional activity in the human genome Human L1 is about 6 kb in length and encodes two open reading frames, ORF1 and ORF2 that are both required for L1 retrotransposition. SINE-VNTR-Alus (SVA) are non-autonomous retrotransposons that are associated with disease in humans. SVAs are evolutionarily young and presumably mobilized by the LINE-1 reverse transcriptase in trans. SVAs are currently active and may impact the host through a variety of mechanisms including insertional mutagenesis, exon shuffling, alternative splicing, and the generation of differentially methylated regions (DMR). Each domain of SVA is derived from either a retrotransposon or a repeat sequence. A canonical SVA is on average ~2 kilobases (kb), but SVA insertions may range in size from 700-4000 basepairs (bp). SVA disease insertions are associated with exon-skipping, deletion of genomic DNA, and reduced or absent mRNA expression.

The present invention provides methods of treating disease and/or disorders or symptoms thereof associated with the insertion of a retrotransposon (e.g., SVA or Alu), which comprise administering a therapeutically effective amount of a pharmaceutical composition comprising an antisense oligonucleotide targeting a retrotransponson (e.g., SVA or Alu) herein to a subject (e.g., a mammal such as a human). Thus, one embodiment is a method of treating a subject suffering from or susceptible to a disease or disorder or symptom thereof associated with the insertion of a TE. The method includes the step of administering to the mammal a therapeutic amount of an amount of a compound herein sufficient to treat the disease or disorder or symptom thereof, under conditions such that the disease or disorder is treated.

The methods herein include administering to the subject (including a subject identified as in need of such treatment) an effective amount of an antisense oligonucleotide described herein, or a composition comprising such antisense oligonucleotides. Identifying a subject in need of such treatment can be in the judgment of a subject or a health care professional and can be subjective (e.g. opinion) or objective (e.g. measurable by a test or diagnostic method).

The therapeutic methods of the invention (which include prophylactic treatment) in general comprise administration of a therapeutically effective amount of the antisense oligonucleotides herein to a subject (e.g., animal, human) in need thereof, including a mammal, particularly a human. Such treatment will be suitably administered to subjects, particularly humans, suffering from, having, susceptible to, or at risk for a disease, disorder, or symptom thereof. Determination of those subjects "at risk" can be made by any objective or subjective determination by a diagnostic test or opinion of a subject or health care provider (e.g., genetic test, enzyme or protein marker, Marker (as defined herein), family history, and the like). The compounds herein may be also used in the treatment of any other disorders in which TEs may be implicated.

In one embodiment, the invention provides a method of monitoring treatment progress. The method includes the step of determining a level of diagnostic marker (Marker) (e.g., a protein whose expression or activity is disrupted by a TE) in a subject suffering from or susceptible to a disorder or symptoms thereof associated with TE insertion, in which the subject has been administered a therapeutic amount of an antisense oligonucleotide herein sufficient to treat the disease or symptoms thereof. The level, length or activity of the Marker determined in the method can be compared to the level, length or activity of the Marker in either healthy normal controls or in other afflicted patients to establish the subject's disease status. In preferred embodiments, a second level of Marker in the subject is determined at a time point later than the determination of the first level, and the two levels are compared to monitor the course of disease or the efficacy of the therapy. In certain preferred embodiments, a pre-treatment level of Marker in the subject is determined prior to beginning treatment according to this invention; this pre-treatment level of Marker can then be compared to the level of Marker in the subject after the treatment commences, to determine the efficacy of the treatment.

Oligonucleotides and Other Nucleobase Oligomers

In one embodiment, an oligonucleotide or nucleobase oligomer of the invention comprises 2'-modified oligonucleotides where some or all internucleotide linkages are modified to phosphorothioates or phosphodiester (PO). The presence of methylphosphonate modifications increases the affinity of the oligonucleotide for its target RNA and thus reduces the IC50. This modification also increases the nuclease resistance of the modified oligonucleotide. It is understood that the methods and reagents of the present invention may be used in conjunction with any technologies that may be developed, including covalently-closed multiple antisense (CMAS) oligonucleotides (Moon et al., Biochem J. 346:295-303, 2000; PCT Publication No. WO 00/61595), ribbon-type antisense (RiAS) oligonucleotides (Moon et al., J. Biol. Chem. 275:4647-4653, 2000; PCT Publication No. WO 00/61595), and large circular antisense oligonucleotides (U.S. Patent Application Publication No. US 2002/0168631 A1).

As is known in the art, a nucleoside is a nucleobase-sugar combination. The base portion of the nucleoside is normally a heterocyclic base. The two most common classes of such heterocyclic bases are the purines and the pyrimidines. Nucleotides are nucleosides that further include a phosphate group covalently linked to the sugar portion of the nucleoside. For those nucleosides that include a pentofuranosyl sugar, the phosphate group can be linked to either the 2', 3' or 5' hydroxyl moiety of the sugar. In forming oligonucleotides, the phosphate groups covalently link adjacent nucleosides to one another to form a linear polymeric compound. In turn, the respective ends of this linear polymeric structure can be further joined to form a circular structure; open linear structures are generally preferred. Within the oligonucleotide structure, the phosphate groups are commonly referred to as forming the backbone of the oligonucleotide. The normal linkage or backbone of RNA and DNA is a 3' to 5' phosphodiester linkage.

Specific examples of preferred nucleobase oligomers useful in this invention include oligonucleotides containing modified backbones or non-natural internucleoside linkages. As defined in this specification, nucleobase oligomers having modified backbones include those that retain a phosphorus atom in the backbone and those that do not have a phosphorus atom in the backbone. For the purposes of this specification, modified oligonucleotides that do not have a phosphorus atom in their internucleoside backbone are also considered to be nucleobase oligomers.

Nucleobase oligomers that have modified oligonucleotide backbones include, for example, phosphorothioates, chiral phosphorothioates, phosphorodithioates, phosphotriesters, aminoalkyl-phosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriest-ers, and boranophosphates having normal 3'-5' linkages, 2'-5' linked analogs of these, and those having inverted polarity, wherein the adjacent pairs of nucleoside units are linked 3'-5' to 5'-3' or 2'-5' to 5'-2'. Various salts, mixed salts and free acid forms are also included. Representative United States patents that teach the preparation of the above phosphorus-containing linkages include, but are not limited to, U.S. Pat. Nos. 3,687,808; 4,469,863; 4,476,301; 5,023,243; 5,177,196; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,306; 5,550,111; 5,563,253; 5,571,799; 5,587,361; and 5,625,050, each of which is herein incorporated by reference.

Nucleobase oligomers having modified oligonucleotide backbones that do not include a phosphorus atom therein have backbones that are formed by short chain alkyl or cycloalkyl internucleoside linkages, mixed heteroatom and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and CH2 component parts. Representative United States patents that teach the preparation of the above oligonucleotides include, but are not limited to, U.S. Pat. Nos. 5,034,506; 5,166,315; 5,185,444; 5,214,134; 5,216,141; 5,235,033; 5,264,562; 5,264,564; 5,405,938; 5,434,257; 5,466,677; 5,470,967; 5,489,677; 5,541,307; 5,561,225; 5,596,086; 5,602,240; 5,610,289; 5,602,240; 5,608,046; 5,610,289; 5,618,704; 5,623,070; 5,663,312; 5,633,360; 5,677,437; and 5,677,439, each of which is herein incorporated by reference.

In other nucleobase oligomers, both the sugar and the internucleoside linkage, i.e., the backbone, are replaced with novel groups. The nucleobase units are maintained for hybridization with a TE. One such nucleobase oligomer, is referred to as a Peptide Nucleic Acid (PNA). In PNA compounds, the sugar-backbone of an oligonucleotide is replaced with an amide containing backbone, in particular an aminoethylglycine backbone. The nucleobases are retained and are bound directly or indirectly to aza nitrogen atoms of the amide portion of the backbone. Methods for making and using these nucleobase oligomers are described, for example, in "Peptide Nucleic Acids: Protocols and Applications" Ed. P. E. Nielsen, Horizon Press, Norfolk, United Kingdom, 1999. Representative United States patents that teach the preparation of PNAs include, but are not limited to, U.S. Pat. Nos. 5,539,082; 5,714,331; and 5,719,262, each of which is herein incorporated by reference. Further teaching of PNA compounds can be found in Nielsen et al., Science, 1991, 254, 1497-1500.

In particular embodiments of the invention, the nucleobase oligomers have phosphorothioate backbones and nucleosides with heteroatom backbones, and in particular —$CH_2$—NH—O—$CH_2$—, —$CH_2$—N($CH_3$)—O—$CH_2$— (known as a methylene (methylimino) or MMI backbone), —$CH_2$—O—N($CH_3$)—$CH_2$—, —$CH_2$—N($CH_3$)—N($CH_3$)—$CH_2$—, and —O—N($CH_3$)—$CH_2$—$CH_2$—. In other embodiments, the oligonucleotides have morpholino backbone structures described in U.S. Pat. No. 5,034,506.

Nucleobase oligomers may also contain one or more substituted sugar moieties. Nucleobase oligomers comprise one of the following at the 2' position: OH; F; O-, S-, or N-alkyl; O-, S-, or N-alkenyl; O-, S- or N-alkynyl; or O-alkyl-O-alkyl, wherein the alkyl, alkenyl, and alkynyl may be substituted or unsubstituted $C_1$ to $C_{10}$ alkyl or $C_2$ to $C_{10}$ alkenyl and alkynyl. Particularly preferred are O[($CH_2$)$_n$O]$_m$$CH_3$, O($CH_2$)$_n$O$CH_3$, O($CH_2$)$_n$NH$_2$, O($CH_2$)$_n$$CH_3$, O($CH_2$)$_n$ON$H_2$, and O($CH_2$)$_n$ON[($CH_2$)$_n$$CH_3$)]2, where n and m are from 1 to about 10. Other preferred nucleobase oligomers include one of the following at the 2' position: C1 to C10 lower alkyl, substituted lower alkyl, alkaryl, aralkyl, O-alkaryl, or O-aralkyl, SH, SCH$_3$, OCN, Cl, Br, CN, CF$_3$, OCF$_3$, SOCH$_3$, SO$_2$CH$_3$, ONO$_2$, NO$_2$, NH$_2$, heterocycloalkyl, heterocycloalkaryl, aminoalkylamino, polyalkylamino, substituted silyl, an RNA cleaving group, a reporter group, an intercalator, a group for improving the pharmacokinetic properties of a nucleobase oligomer, or a group for improving the pharmacodynamic properties of an nucleobase oligomer, and other substituents having similar properties. Preferred modifications are 2'-O-methyl and 2'-methoxyethoxy (2'-O—$CH_2CH_2OCH_3$, also known as 2'-O-(2-methoxyethyl) or 2'-MOE). Another desirable modification is 2'-dimethylaminooxyethoxy (i.e., O($CH_2$)$_2$ON($CH_3$)$_2$), also known as 2'-DMAOE. Other modifications include, 2'-aminopropoxy (2'-O$CH_2CH_2CH_2NH_2$) and 2'-fluoro (2'-F). Similar modifications may also be made at other positions on an oligonucleotide or other nucleobase oligomer, particularly the 3' position of the sugar on the 3' terminal nucleotide or in 2'-5' linked oligonucleotides and the 5' position of 5' terminal nucleotide. Nucleobase oligomers may also have sugar mimetics such as cyclobutyl moieties in place of the pentofuranosyl sugar. Representative United States patents that teach the preparation of such modified sugar structures include, but are not limited to, U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; and 5,700,920, each of which is herein incorporated by reference in its entirety.

Nucleobase oligomers may also include nucleobase modifications or substitutions. As used herein, "unmodified" or "natural" nucleobases include the purine bases adenine (A) and guanine (G), and the pyrimidine bases thymine (T), cytosine (C) and uracil (U). Modified nucleobases include other synthetic and natural nucleobases, such as 5-methylcytosine (5-me-C), 5-hydroxymethyl cytosine, xanthine, hypoxanthine, 2-aminoadenine, 6-methyl and other alkyl derivatives of adenine and guanine; 2-propyl and other alkyl derivatives of adenine and guanine; 2-thiouracil, 2-thiothymine and 2-thiocytosine; 5-halouracil and cytosine; 5-propynyl uracil and cytosine; 6-azo uracil, cytosine and thymine; 5-uracil (pseudouracil); 4-thiouracil; 8-halo, 8-amino, 8-thiol, 8-thioalkyl, 8-hydroxyl and other 8-substituted adenines and guanines; 5-halo (e.g., 5-bromo), 5-trifluoromethyl and other 5-substituted uracils and cytosines; 7-methylguanine and 7-methyladenine; 8-azaguanine and 8-azaadenine; 7-deazaguanine and 7-deazaadenine; and 3-deazaguanine and 3-deazaadenine. Further nucleobases include those disclosed in U.S. Pat. No. 3,687,808, those disclosed in The Concise Encyclopedia Of Polymer Science And Engineering, pages 858-859, Kroschwitz, J. I., ed. John Wiley & Sons, 1990, those disclosed by Englisch et al., Angewandte Chemie, International Edition, 1991, 30, 613, and those disclosed by Sanghvi, Y. S., Chapter 15, Antisense Research and Applications, pages 289-302, Crooke, S. T. and Lebleu, B., ed., CRC Press, 1993. Certain of these nucleobases are particularly useful for increasing the binding affinity of an antisense oligonucleotide of the invention. These include 5-substituted pyrimidines, 6-azapyrimidines, and N-2, N-6 and 0-6 substituted purines, including 2-aminopropyladenine, 5-propynyluracil and 5-propynylcytosine. 5-methylcytosine substitutions have been shown to increase nucleic acid duplex stability by 0.6-1.2.degree. C. (Sanghvi, Y. S., Crooke, S. T. and Lebleu, B., eds., Antisense Research and Applications, CRC Press, Boca Raton, 1993, pp. 276-278) and are desirable base substitutions, even more particularly when combined with 2'-O-methoxyethyl or 2'-O-methyl sugar modifications. Representative United States patents that teach the preparation of certain of the above noted modified nucleobases as well as other modified nucleobases include U.S. Pat. Nos. 4,845,205; 5,130,302; 5,134,066; 5,175,273; 5,367,066; 5,432,272; 5,457,187; 5,459,255; 5,484,908; 5,502,177; 5,525,711; 5,552,540; 5,587,469; 5,594,121, 5,596,091; 5,614,617; 5,681,941; and 5,750,692, each of which is herein incorporated by reference.

Another modification of a nucleobase oligomer of the invention involves chemically linking to the nucleobase oligomer one or more moieties or conjugates that enhance the activity, cellular distribution, or cellular uptake of the oligonucleotide. Such moieties include but are not limited to lipid moieties such as a cholesterol moiety (Letsinger et al., Proc. Natl. Acad. Sci. USA, 86:6553-6556, 1989), cholic acid (Manoharan et al., Bioorg. Med. Chem. Let, 4:1053-1060, 1994), a thioether, e.g., hexyl-S-tritylthiol (Manoharan et al., Ann. N.Y. Acad. Sci., 660:306-309, 1992; Manoharan et al., Bioorg. Med. Chem. Let., 3:2765-2770, 1993), a thiocholesterol (Oberhauser et al., Nucl. Acids Res., 20:533-538: 1992), an aliphatic chain, e.g., dodecandiol or undecyl residues (Saison-Behmoaras et al., EMBO J., 10:1111-1118, 1991; Kabanov et al., FEBS Lett., 259:327-330, 1990; Svinarchuk et al., Biochimie, 75:49-54, 1993), a phospholipid, e.g., di-hexadecyl-rac-glycerol or triethylammonium 1,2-di-0-hexadecyl-rac-glycero-3-H-phosphonate (Manoharan et al., Tetrahedron Lett., 36:3651-3654, 1995; Shea et al., Nucl. Acids Res., 18:3777-3783, 1990), a polyamine or a polyethylene glycol chain (Manoharan et al., Nucleosides & Nucleotides, 14:969-973, 1995), or adamantane acetic acid (Manoharan et al., Tetrahedron Lett., 36:3651-3654, 1995), a palmityl moiety (Mishra et al., Biochim. Biophys. Acta, 1264:229-237, 1995), or an octadecylamine or hexylamino-carbonyl-oxycholesterol moiety (Crooke et al., J. Pharmacol. Exp. Ther., 277:923-937, 1996. Representative United States patents that teach the preparation of such nucleobase oligomer conjugates include U.S. Pat. Nos. 4,587,044; 4,605,735; 4,667,025; 4,762,779; 4,789,737; 4,824,941; 4,828,979; 4,835,263; 4,876,335; 4,904,582; 4,948,882; 4,958,013; 5,082,830; 5,109,124; 5,112,963; 5,118,802; 5,138,045; 5,214,136; 5,218,105; 5,245,022; 5,254,469; 5,258,506; 5,262,536; 5,272,250; 5,292,873; 5,317,098; 5,371,241; 5,391,723; 5,414,077; 5,416,203; 5,451,463; 5,486,603; 5,510,475; 5,512,439; 5,512,667; 5,514,785; 5,525,465; 5,541,313; 5,545,730; 5,552,538; 5,565,552; 5,567,810; 5,574,142; 5,578,717; 5,578,718; 5,580,731; 5,585,481; 5,587,371; 5,591,584; 5,595,726; 5,597,696; 5,599,923; 5,599,928; 5,608,046; and 5,688,941, each of which is herein incorporated by reference.

The present invention also includes nucleobase oligomers that are chimeric compounds. "Chimeric" nucleobase oligomers are nucleobase oligomers, particularly oligonucleotides, that contain two or more chemically distinct regions, each made up of at least one monomer unit, i.e., a nucleotide in the case of an oligonucleotide. These nucleobase oligomers typically contain at least one region where the nucleobase oligomer is modified to confer, upon the nucleobase oligomer, increased resistance to nuclease degradation, increased cellular uptake, and/or increased binding affinity for the target nucleic acid. An additional region of the nucleobase oligomer may serve as a substrate for enzymes capable of cleaving RNA:DNA or RNA:RNA hybrids. By way of example, RNase H is a cellular endonuclease which cleaves the RNA strand of an RNA:DNA duplex. Activation of RNase H, therefore, results in cleavage of the RNA target, thereby greatly enhancing the efficiency of nucleobase oligomer inhibition of gene expression. Consequently, comparable results can often be obtained with shorter nucleobase oligomers when chimeric nucleobase oligomers are used, compared to phosphorothioate deoxyoligonucleotides hybridizing to the same target region.

Chimeric nucleobase oligomers of the invention may be formed as composite structures of two or more nucleobase oligomers as described above. Such nucleobase oligomers, when oligonucleotides, have also been referred to in the art as hybrids or gapmers. Representative United States patents that teach the preparation of such hybrid structures include U.S. Pat. Nos. 5,013,830; 5,149,797; 5,220,007; 5,256,775; 5,366,878; 5,403,711; 5,491,133; 5,565,350; 5,623,065; 5,652,355; 5,652,356; and 5,700,922, each of which is herein incorporated by reference in its entirety.

The nucleobase oligomers used in accordance with this invention may be conveniently and routinely made through the well-known technique of solid phase synthesis. Equipment for such synthesis is sold by several vendors including, for example, Applied Biosystems (Foster City, Calif). Any other means for such synthesis known in the art may additionally or alternatively be employed. It is well known to use similar techniques to prepare oligonucleotides such as the phosphorothioates and alkylated derivatives.

The nucleobase oligomers of the invention may also be admixed, encapsulated, conjugated or otherwise associated with other molecules, molecule structures or mixtures of compounds, as for example, liposomes, receptor targeted molecules, oral, rectal, topical or other formulations, for assisting in uptake, distribution and/or absorption. Representative United States patents that teach the preparation of such uptake, distribution and/or absorption assisting formulations include U.S. Pat. Nos. 5,108,921; 5,354,844; 5,416,016; 5,459,127; 5,521,291; 5,543,158; 5,547,932; 5,583,020; 5,591,721; 4,426,330; 4,534,899; 5,013,556; 5,108,921; 5,213,804; 5,227,170; 5,264,221; 5,356,633; 5,395,619; 5,416,016; 5,417,978; 5,462,854; 5,469,854; 5,512,295; 5,527,528; 5,534,259; 5,543,152; 5,556,948; 5,580,575; and 5,595,756, each of which is herein incorporated by reference.

The nucleobase oligomers of the invention encompass any pharmaceutically acceptable salts, esters, or salts of such esters, or any other compound that, upon administration to an animal, is capable of providing (directly or indirectly) the biologically active metabolite or residue thereof. Accordingly, for example, the disclosure is also drawn to prodrugs and pharmaceutically acceptable salts of the compounds of the invention, pharmaceutically acceptable salts of such prodrugs, and other bioequivalents.

The term "pharmaceutically acceptable salts" refers to salts that retain the desired biological activity of the parent compound and do not impart undesired toxicological effects thereto. Pharmaceutically acceptable base addition salts are formed with metals or amines, such as alkali and alkaline earth metals or organic amines. Examples of metals used as cations are sodium, potassium, magnesium, calcium, and the like. Examples of suitable amines are N,N'-dibenzylethylenediamine, chloroprocaine, choline, diethanolamine, dicyclohexylamine, ethylenediamine, N-methylglucamine, and procaine (see, for example, Berge et al., J. Pharma Sci., 66:1-19, 1977). The base addition salts of acidic compounds are prepared by contacting the free acid form with a sufficient amount of the desired base to produce the salt in the conventional manner. The free acid form may be regenerated by contacting the salt form with an acid and isolating the free acid in the conventional manner. The free acid forms differ from their respective salt forms somewhat in certain physical properties such as solubility in polar solvents, but otherwise the salts are equivalent to their respective free acid for purposes of the present invention. As used herein, a "pharmaceutical addition salt" includes a pharmaceutically acceptable salt of an acid form of one of the components of the compositions of the invention. These include organic or inorganic acid salts of the amines. Preferred acid salts are the hydrochlorides, acetates, salicylates, nitrates and phosphates. Other suitable pharmaceutically acceptable salts are well known to those skilled in the art and include basic salts of a variety of inorganic and organic acids, such as, for example, with inorganic acids, such as for example hydrochloric acid, hydrobromic acid, sulfuric acid or phosphoric acid; with organic carboxylic, sulfonic, sulfo or phospho acids or N-substituted sulfamic acids, for example acetic acid, propionic acid, glycolic acid, succinic acid, maleic acid, hydroxymaleic acid, methylmaleic acid, fumaric acid, malic acid, tartaric acid, lactic acid, oxalic acid, gluconic acid, glucaric acid, glucuronic acid, citric acid, benzoic acid, cinnamic acid, mandelic acid, salicylic acid, 4-aminosalicylic acid, 2-phenoxybenzoic acid, 2-acetoxybenzoic acid, embonic acid, nicotinic acid or isonicotinic acid; and with amino acids, such as the 20 alpha-amino acids involved in the synthesis of proteins in nature, for example glutamic acid or aspartic acid, and also with phenylacetic acid, methanesulfonic acid, ethanesulfonic acid, 2-hydroxyethanesulfonic acid, ethane-1,2-disulfonic acid, benzenesulfonic acid, 4-methylbenzenesulfonic acid, naphthalene-2-sulfonic acid, naphthalene-1,5-disulfonic acid, 2- or 3-phosphoglycerate, glucose-6-phosphate, N-cyclohexylsulfamic acid (with the formation of cyclamates), or with other acid organic compounds, such as ascorbic acid. Pharmaceutically acceptable salts of compounds may also be prepared with a pharmaceutically acceptable cation. Suitable pharmaceutically acceptable cations are well known to those skilled in the art and include alkaline, alkaline earth, ammonium and quaternary ammonium cations. Carbonates or hydrogen carbonates are also possible.

For oligonucleotides and other nucleobase oligomers, suitable pharmaceutically acceptable salts include (i) salts formed with cations such as sodium, potassium, ammonium, magnesium, calcium, polyamines such as spermine and spermidine, etc.; (ii) acid addition salts formed with inorganic acids, for example hydrochloric acid, hydrobromic acid, sulfuric acid, phosphoric acid, nitric acid and the like; (iii) salts formed with organic acids such as, for example, acetic acid, oxalic acid, tartaric acid, succinic acid, maleic acid, fumaric acid, gluconic acid, citric acid, malic acid, ascorbic acid, benzoic acid, tannic acid, palmitic acid, alginic acid, polyglutamic acid, naphthalenesulfonic acid, methanesulfonic acid, p-toluenesulfonic acid, naphthalenedisulfonic acid, polygalacturonic acid, and the like; and (iv) salts formed from elemental anions such as chlorine, bromine, and iodine.

The present invention also includes pharmaceutical compositions and formulations that include the nucleobase oligomers of the invention. The pharmaceutical compositions of the present invention may be administered in a number of ways depending upon whether local or systemic treatment is desired and upon the area to be treated. Administration may be topical (including ophthalmic and to mucous membranes including vaginal and rectal delivery), pulmonary, e.g., by inhalation or insufflation of powders or aerosols, including by nebulizer; intratracheal, intranasal, epidermal and transdermal), oral, or parenteral. Parenteral administration includes intravenous, intraarterial, subcutaneous, intraperitoneal, or intramuscular injection or infusion; or intracranial, e.g., intrathecal or intraventricular, administration.

Test Compounds and Extracts

In one aspect, the invention provides methods of screening for agents that have the ability to inhibit splicing with a retrotransposon. Thus, in various embodiments, a test compound will be an antisense oligonucleotide that targets a retrotransposon splice site or a retrotransposon splice enhancer site. Additionally, other compounds may be screened for the desired activity.

In general, small molecule compounds are known in the art or are identified from large libraries of both natural product or synthetic (or semi-synthetic) extracts or chemical libraries or from polypeptide or nucleic acid libraries, according to methods known in the art. Those skilled in the field of drug discovery and development will understand that the precise source of test extracts or compounds is not critical to the screening procedure(s) of the invention. Compounds used in screens may include known compounds (for example, known therapeutics used for other diseases or disorders). Alternatively, virtually any number of unknown chemical extracts or compounds can be screened using the methods described herein. Examples of such extracts or compounds include, but are not limited to, plant-, fungal-, prokaryotic- or animal-based extracts, fermentation broths, and synthetic compounds, as well as modification of existing compounds.

Numerous methods are also available for generating random or directed synthesis (e.g., semi-synthesis or total synthesis) of any number of chemical compounds, including, but not limited to, saccharide-, lipid-, peptide-, and nucleic acid-based compounds. Synthetic compound libraries are commercially available from Brandon Associates (Merrimack, N.H.) and Aldrich Chemical (Milwaukee, Wis.). Alternatively, chemical compounds to be used as candidate compounds can be synthesized from readily available starting materials using standard synthetic techniques and methodologies known to those of ordinary skill in the art. For example, a library of 8,000 novel small molecules is available, which was created using combinatorial methods of Diversity-Oriented Synthesis (DOS) (corner et al, Proc Natl Acad Sci USA 108, 6751 (Apr. 26, 2011; Lowe et al, J Org Chem 77, 7187 (Sep. 7, 2012); Marcaurelle et al, J Am Chem Soc 132, 16962 (Dec. 1, 2010))— to investigate chemical compounds not represented in traditional pharmaceutical libraries (Schreiber, S. L. (2000). Science 287, 1964-1969; Schreiber et al, Nat Biotechnol 28, 904 (September, 2010), each of which is herein incorporated by reference in their entirety). Synthetic chemistry transformations and protecting group methodologies (protection and deprotection) useful in synthesizing the compounds identified by the methods described herein are known in the art and include, for example, those such as described in R. Larock, Comprehensive Organic Transformations, VCH Publishers (1989); T. W. Greene and P. G. M. Wuts, Protective Groups in Organic Synthesis, 2nd ed., John Wiley and Sons (1991); L. Fieser and M. Fieser, Fieser and Fieser's Reagents for Organic Synthesis, John Wiley and Sons (1994); and L. Paquette, ed., Encyclopedia of Reagents for Organic Synthesis, John Wiley and Sons (1995), and subsequent editions thereof.

Alternatively, libraries of natural compounds in the form of bacterial, fungal, plant, and animal extracts are commercially available from a number of sources, including Biotics (Sussex, UK), Xenova (Slough, UK), Harbor Branch Oceangraphics Institute (Ft. Pierce, Fla.), and PharmaMar, U.S.A. (Cambridge, Mass.). In addition, natural and synthetically produced libraries are produced, if desired, according to methods known in the art, e.g., by standard extraction and fractionation methods. Examples of methods for the synthesis of molecular libraries can be found in the art, for example in: DeWitt et al., *Proc. Natl. Acad. Sci. U.S.A.* 90:6909, 1993; Erb et al., *Proc. Natl. Acad. Sci. USA* 91:11422, 1994; Zuckermann et al., *J. Med. Chem.* 37:2678, 1994; Cho et al., *Science* 261:1303, 1993; Carrell et al., *Angew. Chem. Int.*

Ed. Engl. 33:2059, 1994; Carell et al., *Angew. Chem. Int. Ed. Engl.* 33:2061, 1994; and Gallop et al., *J. Med. Chem.* 37:1233, 1994. Furthermore, if desired, any library or compound is readily modified using standard chemical, physical, or biochemical methods.

Libraries of compounds may be presented in solution (e.g., Houghten, Biotechniques 13:412-421, 1992), or on beads (Lam, *Nature* 354:82-84, 1991), chips (Fodor, *Nature* 364:555-556, 1993), bacteria (Ladner, U.S. Pat. No. 5,223,409), spores (Ladner U.S. Pat. No. 5,223,409), plasmids (Cull et al., *Proc Natl Acad Sci USA* 89:1865-1869, 1992) or on phage (Scott and Smith, *Science* 249:386-390, 1990; Devlin, *Science* 249:404-406, 1990; Cwirla et al. *Proc. Natl. Acad. Sci.* 87:63786382, 1990; Felici, *J. Mol. Biol.* 222:301-310, 1991; Ladner supra.).

In addition, those skilled in the art of drug discovery and development readily understand that methods for dereplication (e.g., taxonomic dereplication, biological dereplication, and chemical dereplication, or any combination thereof) or the elimination of replicates or repeats of materials already known for their activity should be employed whenever possible.

When a crude extract is identified as containing a compound of interest, further fractionation of the positive lead extract is necessary to isolate chemical constituents responsible for the observed effect. Thus, the goal of the extraction, fractionation, and purification process is the careful characterization and identification of a chemical entity within the crude extract that achieves a desired biological effect. Methods of fractionation and purification of such heterogenous extracts are known in the art.

Small molecules of the invention preferably have a molecular weight below 2,000 daltons, more preferably between 300 and 1,000 daltons, and most preferably between 400 and 700 daltons. It is preferred that these small molecules are organic molecules.

Therapy

Therapy may be provided wherever therapy associated with a genetic disorder is performed: at home, the doctor's office, a clinic, a hospital's outpatient department, or a hospital. Treatment generally begins at a hospital so that the doctor can observe the therapy's effects closely and make any adjustments that are needed. The duration of the therapy depends on the kind of genetic disorder being treated, the age and condition of the patient, the type of the patient's disease, and how the patient's body responds to the treatment.

An antisense oligonucleotide or antisense nucleobase oligomer of the invention may be administered within a pharmaceutically-acceptable diluent, carrier, or excipient, in unit dosage form. Conventional pharmaceutical practice may be employed to provide suitable formulations or compositions to administer the compounds to patients suffering from a disease that is associated with insertion of a transposable element. Administration may begin before the patient is symptomatic. Any appropriate route of administration may be employed, for example, administration may be parenteral, intravenous, intraarterial, subcutaneous, intratumoral, intramuscular, intracranial, intraorbital, ophthalmic, intraventricular, intrahepatic, intracapsular, intrathecal, intracisternal, intraperitoneal, intranasal, aerosol, suppository, or oral administration. For example, therapeutic formulations may be in the form of liquid solutions or suspensions; for oral administration, formulations may be in the form of tablets or capsules; and for intranasal formulations, in the form of powders, nasal drops, or aerosols.

Methods well known in the art for making formulations are found, for example, in "Remington: The Science and Practice of Pharmacy" Ed. A. R. Gennaro, Lippincourt Williams & Wilkins, Philadelphia, Pa., 2000. Formulations for parenteral administration may, for example, contain excipients, sterile water, or saline, polyalkylene glycols such as polyethylene glycol, oils of vegetable origin, or hydrogenated napthalenes. Biocompatible, biodegradable lactide polymer, lactide/glycolide copolymer, or polyoxyethylene-polyoxypropylene copolymers may be used to control the release of the compounds. Other potentially useful parenteral delivery systems for TE antisense oligonucleotides include ethylene-vinyl acetate copolymer particles, osmotic pumps, implantable infusion systems, and liposomes. Formulations for inhalation may contain excipients, for example, lactose, or may be aqueous solutions containing, for example, polyoxyethylene-9-lauryl ether, glycocholate and deoxycholate, or may be oily solutions for administration in the form of nasal drops, or as a gel.

The formulations can be administered to human patients in therapeutically effective amounts (e.g., amounts which prevent, eliminate, or reduce a pathological condition) to provide therapy for a disease or condition. The preferred dosage of a nucleobase oligomer of the invention is likely to depend on such variables as the type and extent of the disorder, the overall health status of the particular patient, the formulation of the compound excipients, and its route of administration.

For any of the methods of application described above, a nucleobase oligomer of the invention is desirably administered intravenously or is applied to the site of the needed intervention (e.g., by injection).

Kits

The invention provides kits for the treatment or prevention of a genetic disease associated with insertion of a transposable element. In one embodiment, the kit includes a pharmaceutical pack comprising an effective amount of an antisense oligonucleotide that targets a splice acceptor site associated with insertion of a transposable element or which targets a sequence associated with the transposable element (e.g., SVA sequence). Preferably, the compositions are present in unit dosage form. In some embodiments, the kit comprises a sterile container which contains a therapeutic or prophylactic composition; such containers can be boxes, ampules, bottles, vials, tubes, bags, pouches, blister-packs, or other suitable container forms known in the art. Such containers can be made of plastic, glass, laminated paper, metal foil, or other materials suitable for holding medicaments.

If desired compositions of the invention or combinations thereof are provided together with instructions for administering them to a subject having a genetic disorder associated with insertion of a transposable element. The instructions will generally include information about the use of the compounds for the treatment or prevention of the genetic disorder. In other embodiments, the instructions include at least one of the following: description of the oligonucleotide(s); dosage schedule and administration for treatment of a genetic disorder or symptoms thereof; precautions; warnings; indications; counter-indications; overdosage information; adverse reactions; animal pharmacology; clinical studies; and/or references. The instructions may be printed directly on the container (when present), or as a label applied to the container, or as a separate sheet, pamphlet, card, or folder supplied in or with the container.

The practice of the present invention employs, unless otherwise indicated, conventional techniques of molecular biology (including recombinant techniques), microbiology, cell biology, biochemistry and immunology, which are well within the purview of the skilled artisan. Such techniques are explained fully in the literature, such as, "Molecular Cloning: A Laboratory Manual", second edition (Sambrook, 1989); "Oligonucleotide Synthesis" (Gait, 1984); "Animal Cell Culture" (Freshney, 1987); "Methods in Enzymology" "Handbook of Experimental Immunology" (Weir, 1996); "Gene Transfer Vectors for Mammalian Cells" (Miller and Calos, 1987); "Current Protocols in Molecular Biology"

(Ausubel, 1987); "PCR: The Polymerase Chain Reaction", (Mullis, 1994); "Current Protocols in Immunology" (Coligan, 1991). These techniques are applicable to the production of the polynucleotides and polypeptides of the invention, and, as such, may be considered in making and practicing the invention. Particularly useful techniques for particular embodiments will be discussed in the sections that follow.

The following examples are put forth so as to provide those of ordinary skill in the art with a complete disclosure and description of how to make and use the assay, screening, and therapeutic methods of the invention, and are not intended to limit the scope of what the inventors regard as their invention.

EXAMPLES

Example 1: Antisense Oligonucleotides for the Treatment of Genetic Disease

A child presented with a severe rapidly progressing neurodegenerative disease affecting the brain and retina, whose symptoms were consistent with Batten Disease, which is a rare recessive genetic disorder. Sequence analysis of a biological sample from the child identified the presence of a heterozygous mutation, heterozygous mutation in MFSD8, designated 1102G.C, which is predicted to results in an amino acid substitution (Asp368His). This variant is located at the last nucleotide of an exon and is predicted to result in defective splicing. It had previously been reported in the homozygous state in one patient affected with NCL. It was also reported in the heterozygous state with another missense variant in a patient with macular dystrophy.

Figure 2:
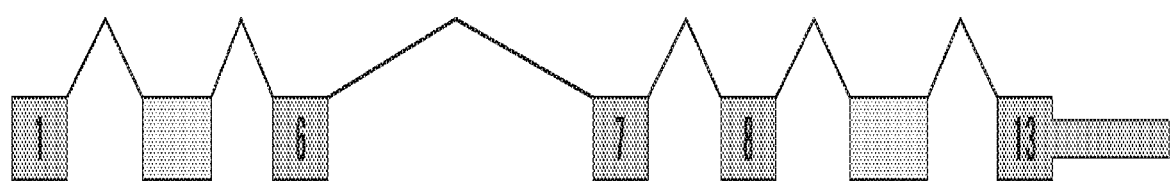
FIG. 2 is a schematic diagram showing the splicing of native MFSD8 and the MFSD8 gene truncation resulting from the introduction of a stop codon in a cryptic exon associated with insertion of the SVA transposon.
Figure 2:
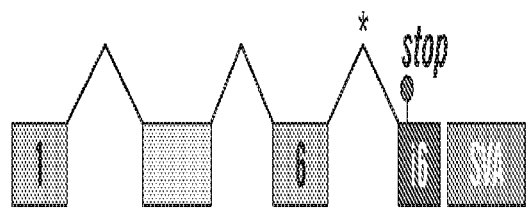

The presence of a single heterozygous mutation in an affected patient was unexpected given that Batten disease is a recessive genetic disorder. This begs the question of where the second allele is? Whole genome sequencing of the affected child, parents and a sibling identified the insertion of a retrotransposon in the affected child's genome present at a position on the chromosome corresponding to an intron of MFSD8/CLN7 (FIG. 1, FIG. 2). Whole genome sequencing (WGS) was carried out using the following oligonucleotides. Point mutations detected via WGS were confirmed by PCR amplification and Sanger sequencing. The SVA transposon insertion was confirmed by PCR amplification and a series of primer walking experiments. Primer sequences are provided in the table below.

TABLE 1

| Primer name | Sequence |
| --- | --- |
| TY701-MFSD8-intron6-F1 | CGGTAGGTGCAATATTTTAGTCC |
| TY702-MFSD8-intron6-R1 | ACTGCTGGATAAAGCACTCTAAA |
| TY703-MFSD8-intron6-F2 | GCCTGAAAAGCTTCGATGAC |
| TY704-MFSD8-intron6-R2 | TGGCAAAAACTCAATTGGAA |
| TY706-MFSD8-intron6-SVAC2-R12 | CACCGCCCTTAATCCATTT |
| TY708-MFSD8-intron6-SVAC2-F11 | AAGGCAGCATGCTCGTTAAG |
| TY711-MFSD8-intron6-Ghr20-R13 | TCAACATCCATTCTTGACCA |
| TY712-MFSD8-intron6-Chr20-F13 | CAATTTTGGTCAAGAATGGATG |
| TY719-MFSD8-intron6-5'-F5 | TTCCAATAATAAGCCCTCAACAA |
| TY720-MRSD8-intron6-5'-F6 | CCAGTCTACCCTCAGTATCTAGCA |
| TY721-MFSD8-intron6-5'-F7 | CATGAGGACATGGTTTGAGTCT |
| TY725-MFSD8-Tra-SVAR-R-31 | GCCTCCACACCACTGAGC |
| TY727-708 MUTATION-F | AGGGCAGCATGCTCGTTGAG |
| TY728-MFSD8-intron6-Chr20-R | ACCAGTTTAATAAAAGAAACAAGAATG |
| TY729-MFSD8-Exon6-F1 | TGCTGGTGCTACTTCCCTTC |
| TY730-MFSD8-Exon5-F2 | AACAAGTTCCATGGCAAACA |
| TY731-MFSD8-Exon7-R1 | TCACATCCCATGTCACACCT |
| TY732-MFSD8-trans-SVAE-R | TATCCACACAGACCCAGCAA |
| TY 735-Seq-Transpo-727-R | GGAGGGAAGGTCAGCAGATA |
| TY 736-Seq-Transpo-732-F | GGCGGTTTTGTGGAATAGAA |

Figure 5A:
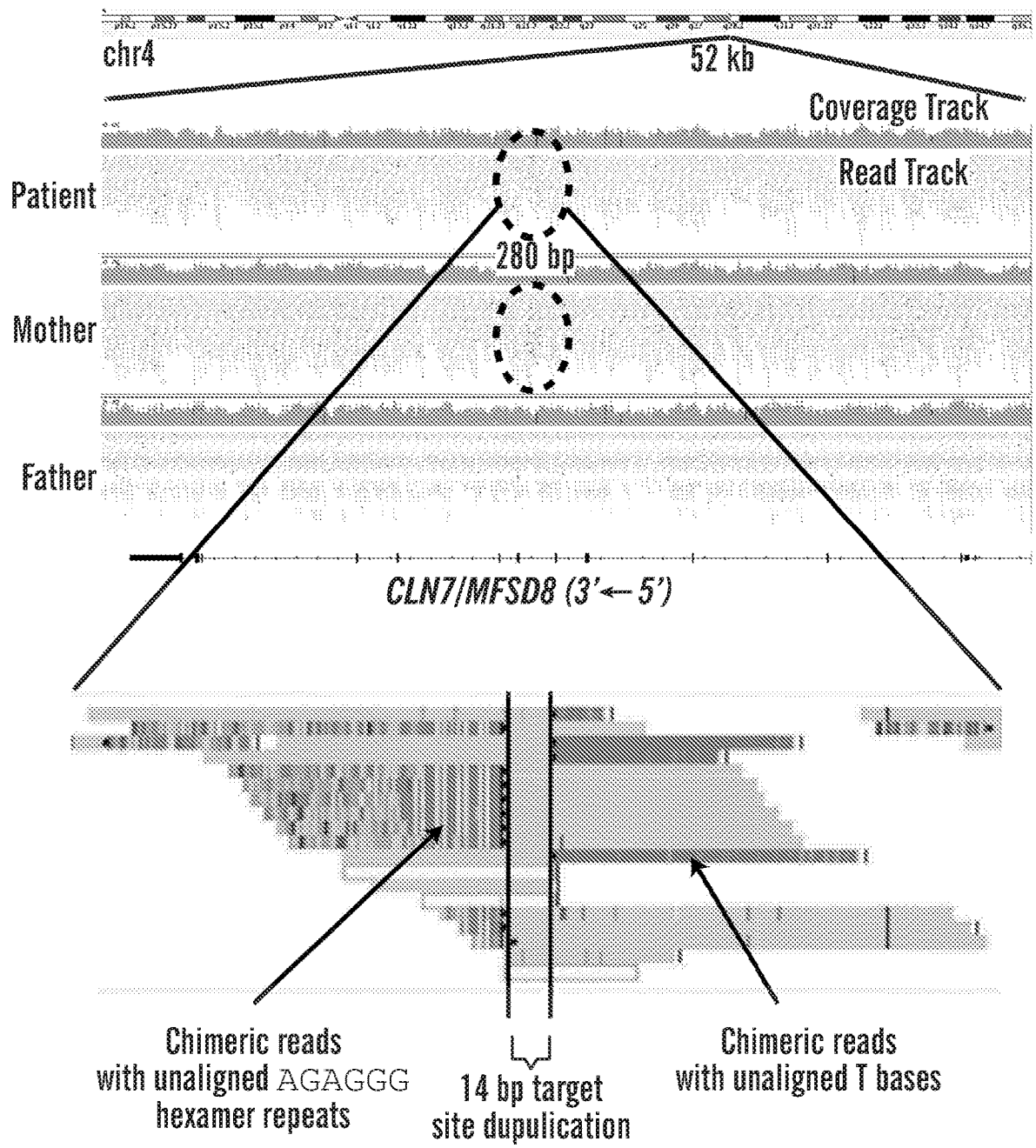
FIG. 5A is a schematic diagram showing a comparative examination of WGS read alignments reveals a cluster of chimeric reads in the subject and mother, which is characteristic of retrotransposon insertion. Integrative Genomics Viewer (IGV) image showing WGS read alignments in the ~52 kb region of chromosome 4 with CLN7/MSD8 gene (top panel). Blow-up image of the ~280 bp region (bottom panel), where two groups of chimeric reads were found: one group with a stretch of T bases on one end, another group with hexameric repeats on the other end. The two groups of chimeric reads shared a common 14 bp region that aligns well to the reference genome; this region corresponds to the duplicated retrotransposon target/entry site, often called "target site duplication."
Figure 5B:
FIG. 5B is a schematic of chimeric sequence reads showing CLN7 intron 6 fused to polyT sequences.
Figure 5C:
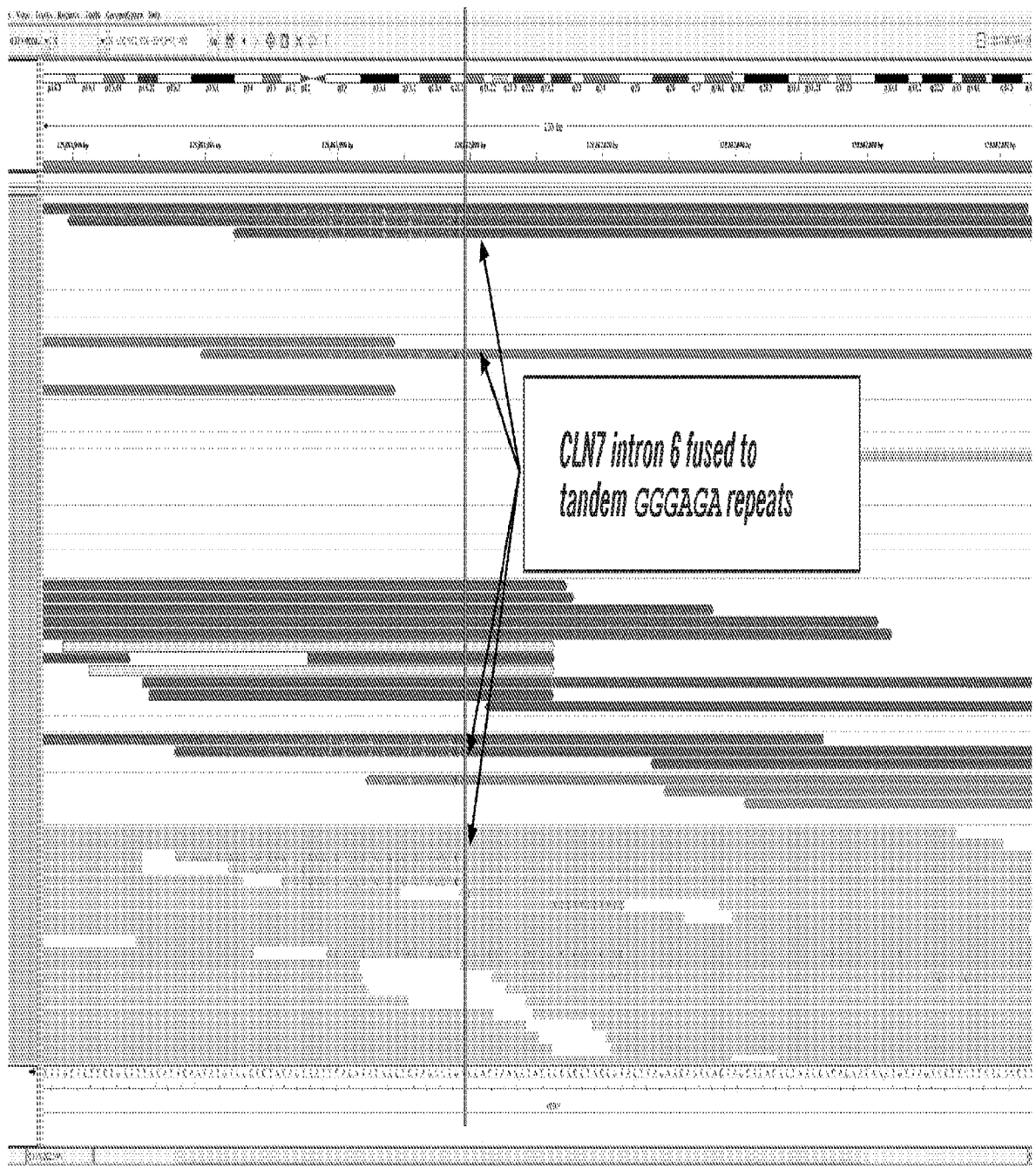
FIG. 5C is a schematic of chimeric sequence reads showing CLN7 intron 6 fused to tandem GGGAGA repeats.
Figure 5D:
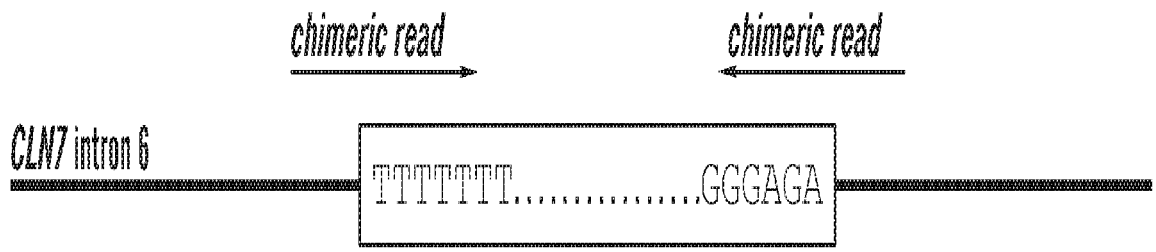
FIG. 5D is a schematic depicting identification of the insertion of the SVA transposon in CLN7 intron 6 of the patient.
Figure 5E:
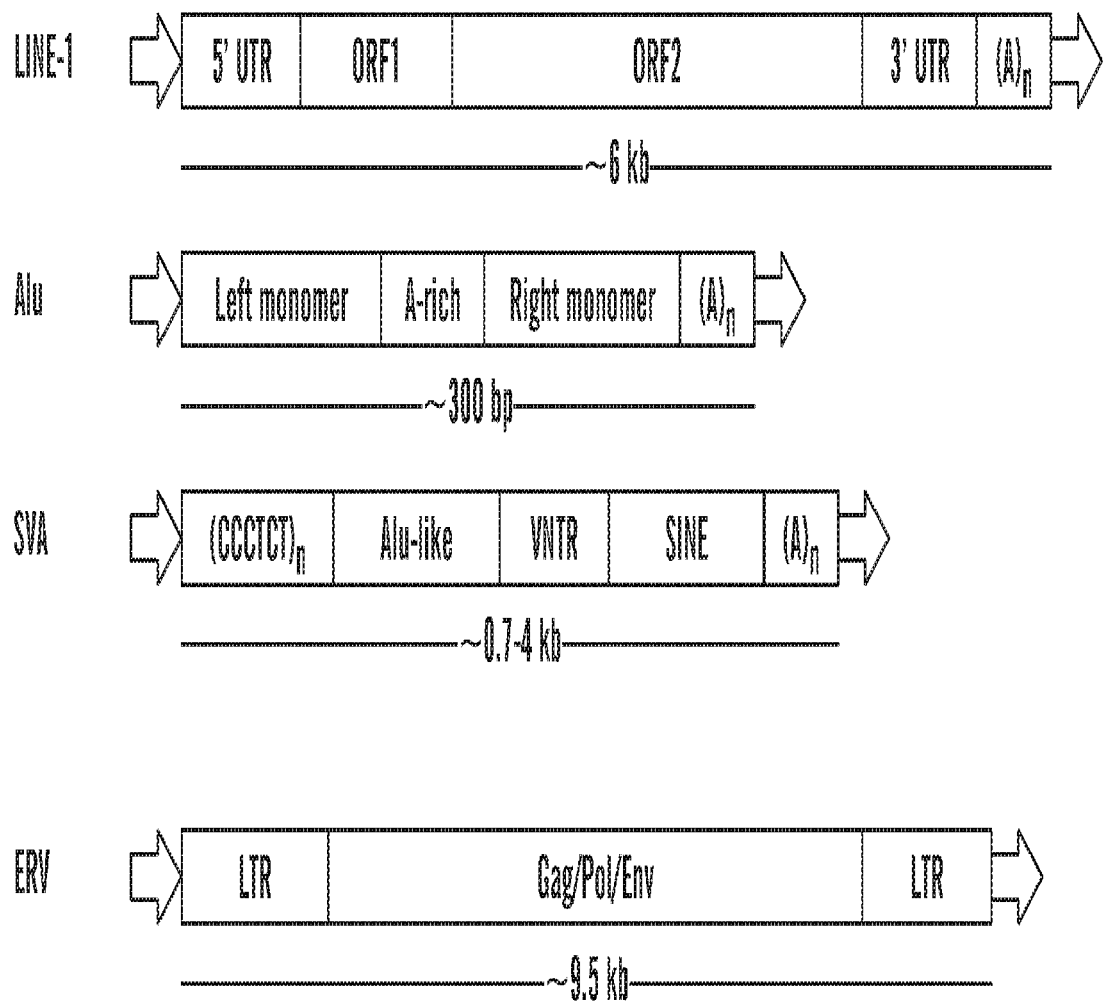
FIG. 5E provides schematic diagrams of transposons.
Figure 5F:
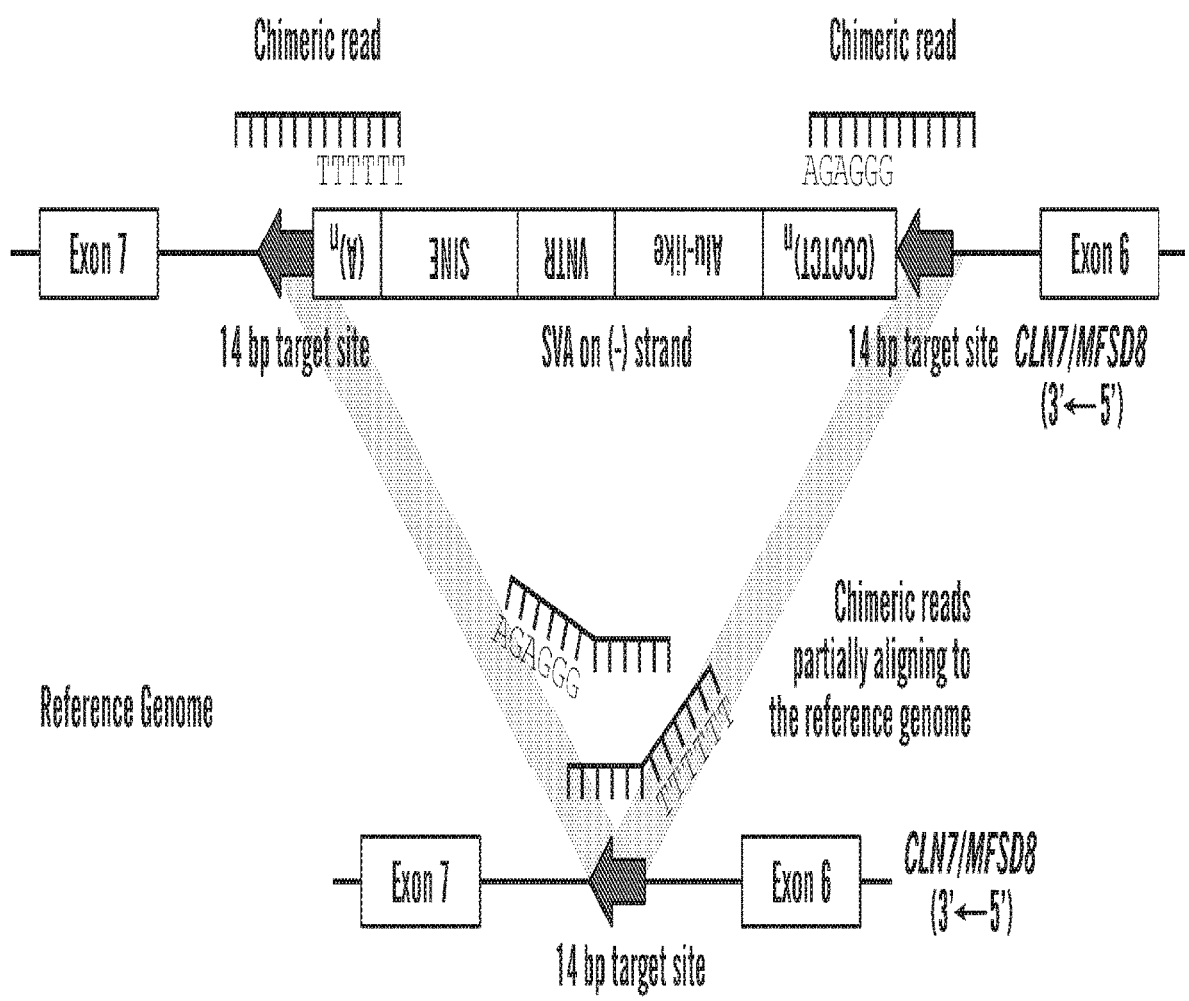
FIG. 5F provides a schematic illustrating how chimeric reads derived from the subject would align on the reference genome. As the SVA transposon is inserted in the minus strand of the subject's genome (i.e. the sense strand of CLN7/MSD8), WGS reads from the boundaries of the insertion will only partially align to the reference genome with the "soft-clipped" overhang of either polyT or hexameric repeat sequences.

WGS unexpectedly revealed a maternally inherited retrotransposon insertion into intron 6 of the subject's CLN7/MFSD8 gene. When WGS reads from the subject were aligned to the reference genome and visualized in Integrative Genomics Viewer (IGV), the insertion manifested as a cluster of "chimeric reads" that aligned only partially to the reference genome, because they spanned the boundaries of the reference sequence and the foreign sequence (FIG. 5A, top). The chimeric read cluster was detected in the subject and her mother, but not her father, indicating maternal inheritance of the insertion. Inspection of the chimeric read alignments showed that they either had unmapped (a.k.a. "soft-clipped") polyT sequences on one end or unmapped hexameric repeat sequences (AGAGGG) on the other end, indicating that the insertion contained these motifs at the boundaries (FIG. 5A, bottom). In addition, the chimeric read breakpoints flanked a 14 bp sequence that aligns well to all chimeric reads, suggesting that this 14 bp endogenous sequence was duplicated and is present in both boundaries of the insertion. These features (polyT stretch, hexameric repeats, and retrotransposon target site duplication) were consistent with the insertion of SVA family retrotransposon into the minus strand of the reference genome, the sense strand of CLN7/MFSD8 (FIGS. 5E and 5F).

Figure 5G:
FIG. 5G is a diagram showing the results of Sanger sequencing and CLIA-based genome analyses, which confirm the SVA retrotransposon insertion in the subject and mother's genome. The insertion was not observed in the father and brother's genomes. The location, length, and context of the SVA insertion in the subject and mother's CLN7/MFSD8 allele are displayed in the sense direction (minus strand of the reference genome). Also shown are the locations of Sanger sequencing primers used to sequence and assemble the full retrotransposon consensus sequence.
Figure 5G:
Figure 5G:
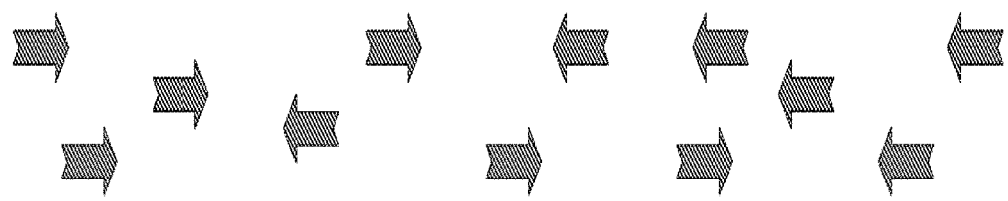
Figure 5H:
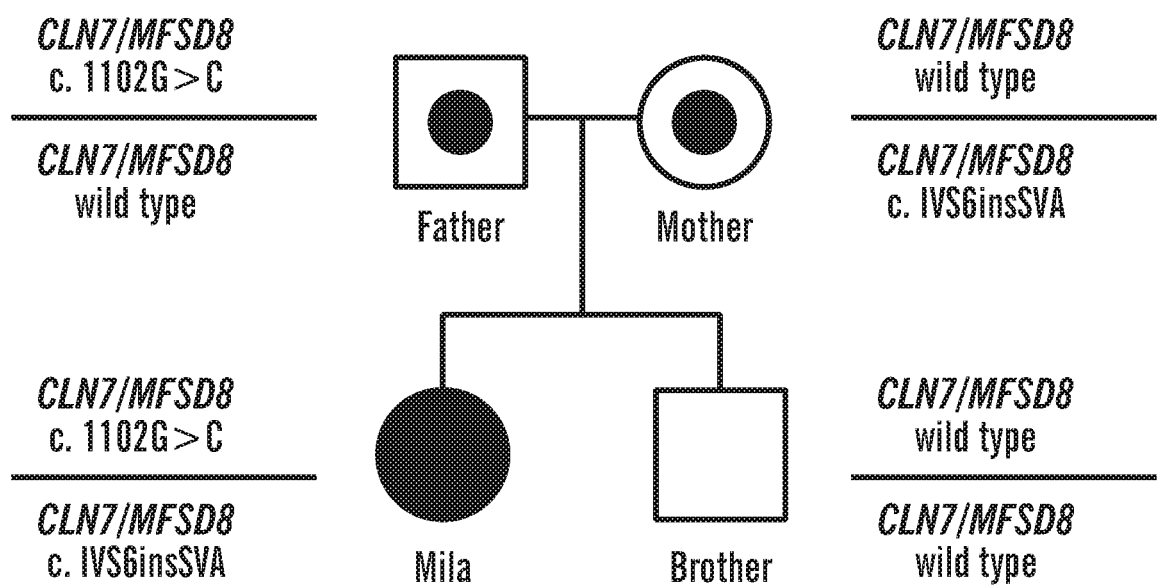
FIG. 5H is a diagram showing the CLN7/MFSD8 mutation status of the four members of the subject's family, which was confirmed by CLIA-based genome analysis.

PCR amplification and Sanger sequencing using a primer walking approach was employed to sequence across the breakpoints, revealing a ~2 kb insertion in both the subject and in her mother (FIG. 5G). RepeatMasker analysis confirmed that the sequenced insertion was indeed a SVA retrotransposon. The presence of this SVA was also confirmed on a CLIA basis both in the subject and in her mother by Claritas Genomics. CLIA analysis also confirmed absence of the SVA insertion in the subject's father, and also demonstrated that the subject's brother bore neither the SVA insertion nor the paternal missense mutation (CLN7/MFSD8 c.1102G>C) (FIG. 5G, 5H). The segregation pattern of the SVA insertion is therefore consistent with it being the pathogenic cause (in combination with c.1102G>C) of neurodegeneration in the subject. SVA retrotransposons are the youngest and most active family of retrotransposons in the human genome. They are specific to hominids, and are present in ~2700 copies per genome (representing ~0.2% of the human genome). There have been thirteen documented cases of SVA insertions causing Mendelian disease in human by interrupting a human disease-associated gene. the subject's SVA insertion into CLN7/MFSD8 has never been reported.

Figure 5I:
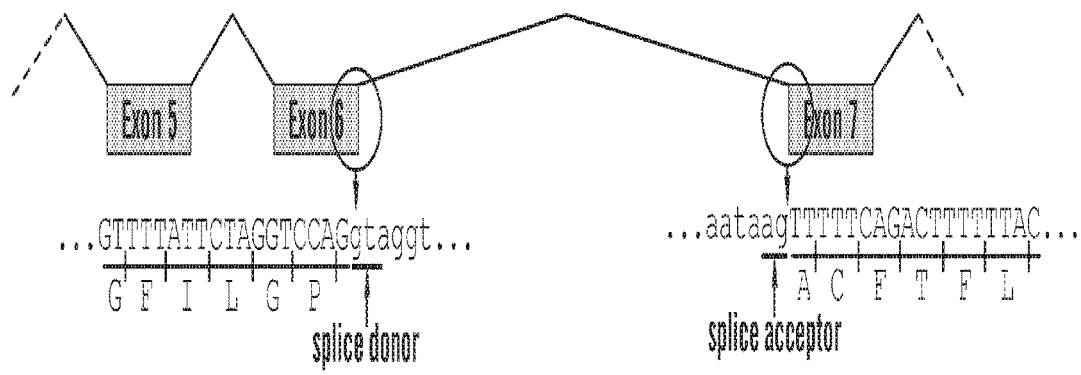
FIG. 5I depicts results of RNA-seq and RT-PCR analyses, which showed that the SVA retrotransposon insertion causes exon trapping and resulting premature translational termination. Exon trapping and premature translational termination of CLN7/MFSD8 by the SVA retrotransposon insertion, was revealed by the blood RNA-seq analysis of the subject's four family members.
Figure 5I:
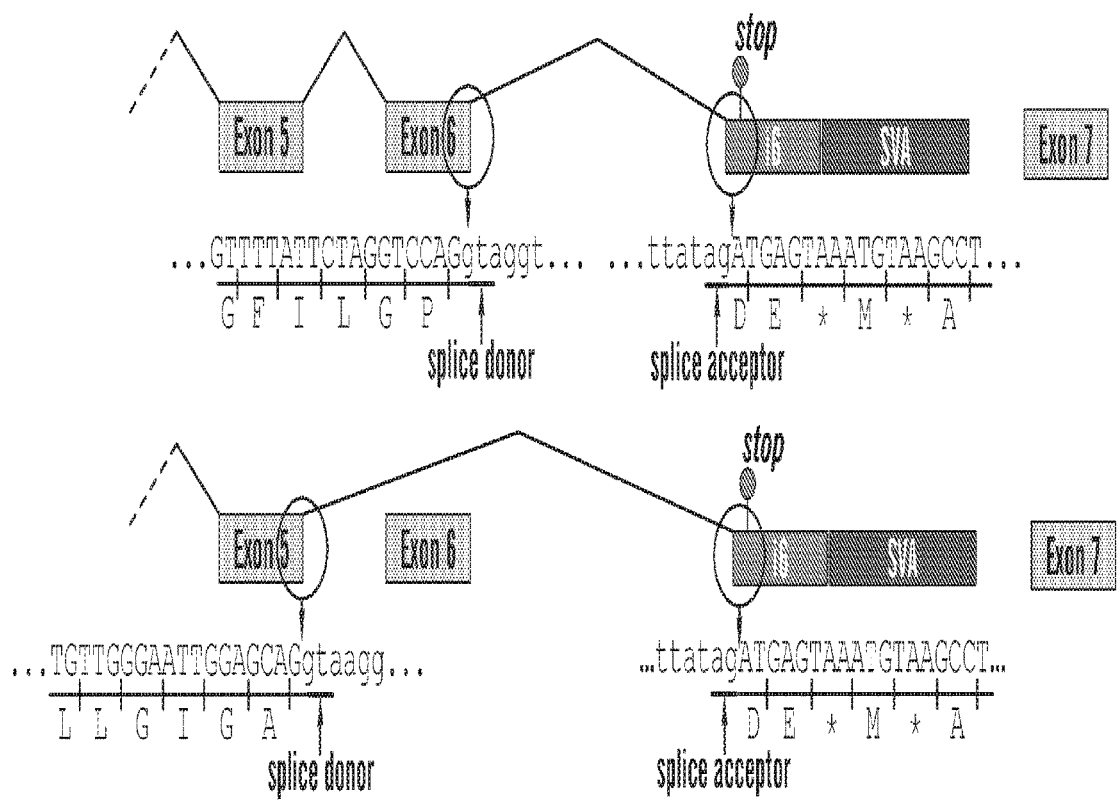
Figure 5J:
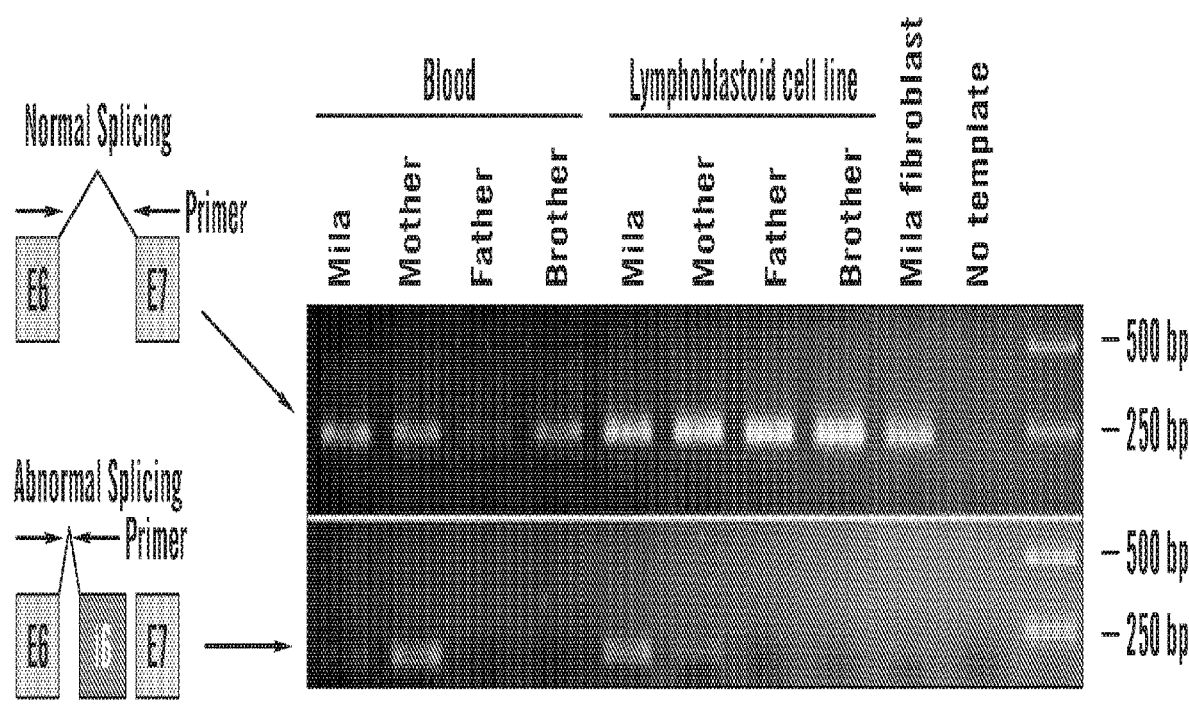
FIG. 5J shows RT-PCR confirmation of the exon trapping by SVA retrotransposon in the subject and mother.

SVA retrotransposons are known to encode strong splice enhancer sequences that modulate patterns of splicing of nearby genes, sometimes resulting in exon trapping (Hancks et al, Genome Research 2009). To understand whether this may be occurring with the subject's SVA retrotransposon, splicing patterns were examined using RNA-seq analysis. Splice junction analysis of >126 million read pairs, using polyA+ RNA isolated from the subject's whole blood, revealed that SVA retrotransposon insertion into intron 6 activates a cryptic splice site ("i6.SA") 133 basepairs upstream of the insertion site (FIG. 5I). Splicing from exon 6 into i6.SA was detected in RNA isolated from the subject as well as from her mother, but neither her father nor her brother (who do not carry the SVA insertion). These results were confirmed with RT-PCR from patient fibroblasts and from whole blood and lymphoblasts from all four family members (FIG. 5J). Abnormal splicing into i6. SA results in an immediate stop codon and truncation of the CLN7/MFSD8 protein product (p.184PhefsX3).

The retrotransposon insertion was discovered by chimeric reads with intron 6 sequences fused to polyT and tandem GGGAGA repeats, respectively (FIGS. 5A-5D). This retrotransposon insertion generated a stop codon in the intron following exon six, resulting in MFSD8 gene truncation and loss of protein function (FIG. 2). In essence, the transposon insertion was acting as an exon trap. Exon trapping is a molecular biology technique used to identify the presence of exons in a fragment of DNA. In exon trapping a genomic fragment of unknown intron/exon structure is inserted into the intron of a splicing vector consisting of a known exon-intron-exon sequence of DNA. If the fragment does not contain exons (i.e., consists solely of intron DNA), it will be spliced out together with the vector's original intron. On the other hand, if exons are contained, the exons will be part of the mature mRNA after transcription (with all intron material removed). The presence of 'trapped exons' can be detected by an increase in size of the mRNA.

Figure 3:
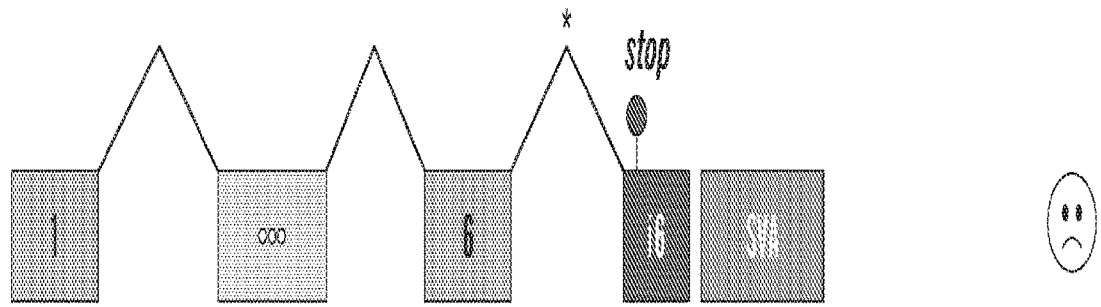
FIG. 3 is a schematic diagram showing the strategy for use of an exon skipping drug to block a splice acceptor site and restore normal gene splicing.
Figure 3:
Figure 3:
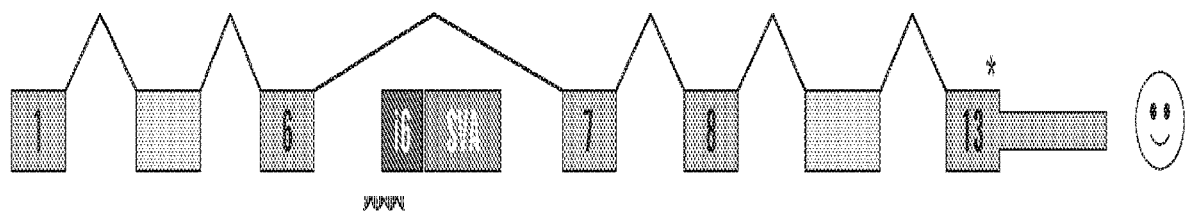
Figure 4:
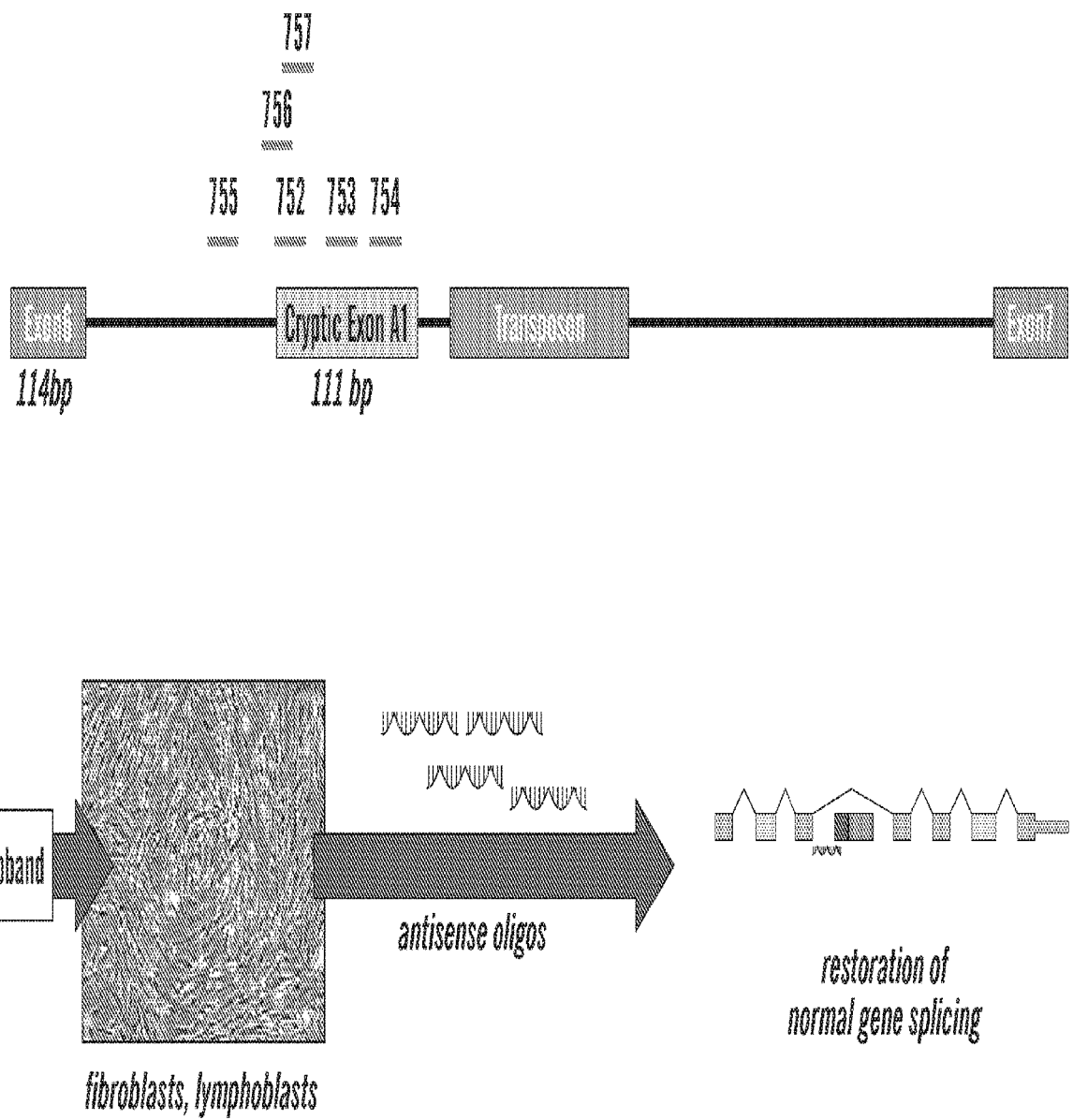
FIG. 4 is a schematic diagram showing the strategy for use of antisense oligonucleotides to restore normal gene splicing in the proband's MFSD8 gene.

The genetic disorder present in the affected child could be ameliorated if the stop codon produced by the intron could be skipped allowing restoration of the normal reading frame (FIG. 3, FIG. 4).

Exon skipping, or splice modulation in general, can be treated by antisense oligonucleotide therapy. Exon skipping is achieved using antisense oligonucleotides, which have the ability to hybridize to a sense target sequence, modulating splicing patterns of the target molecule. Antisense-mediated exon skipping has been shown to be useful for the restoration of a normal reading frame in genes impaired by mutations that alter undesirable gene splicing. This approach can be effective when the skipped exon is not critical for protein function, or when a non-productive exon is brought into play by a patient mutation. Exon skipping has been used to treat Duchenne's Muscular Dystrophy, where partial protein function is maintained despite the absence of the skipped exons, as well as spinal muscular atrophy, where full protein function is restored by restoring normal splicing patterns to a functionally substitutable pseudogene.

To determine whether steric blockade via an antisense oligonucleotide could be utilized to rescue CLN7/MFSD8 exon trapping induced by subject's SVA, a series of antisense oligonucleotides, complementary to the i6.SA cryptic splice acceptor site and nearby computationally predicted splice enhancers (RESCUE-ESE (Fairbrother et al., 2004) and ESEfinder (Smith et al., 2006) (FIG. 6A) were designed and synthesized.

Antisense oligonucleotides were generated to target the splice acceptor site and predicted splice enhancer sequences flanking it. Exemplary antisense oligonucleotides that were generated and tested are shown at the following Table 2A.

TABLE 2A

| Antisense Oligonucleotides Targeting Splice Enhancer Sequences | |
|---|---|
| Name | Sequence |
| TY790 (TY777A) | TTAGTGCTTGTTGAGGGC |
| TY791 (TY777B) | GTTAGTGCTTGTTGAGGG |
| TY792 (TY777C) | TGTTAGTGCTTGTTGAGG |
| TY793 (TY777D) | ATGTTAGTGCTTGTTGAG |
| TY777-MFSD8ASO-2MOE | AATGTTAGTGCTTGTTGAGGGC |

Additional sequences of the antisense oligonucleotides used in these studies, designed to be complementary to computationally predicted splice enhancers surrounding the i6.SA splice site, are shown in following Table 2B (SEQ ID NOS: 2578-2585, respectively, in order of appearance).

Milasen/TY777 was investigated using (1) qRT-PCR experiments to study dose-response relationships and (2) RNA-seq to confirm its splice correction effect. First, when electroporated into patient fibroblasts at a range of doses (0, 1, 10, 20, 50, 100, 200, 500 nM), milasen/TY777 demon-

| ASO name | Sequence | Modifications | Manufacturer |
|---|---|---|---|
| TY765-MFSD8-ASO-1 | AGCUUUUCAGGCUUACAUUUACUCAUCU | PS 2'-OMe | IDT |
| TY766-MFSD8-ASO | AAUGUUAGUGCUUGUUGAGGGC | PS 2'-OMe | IDT |
| TY767-5MFSD8-ASO- | CUAGCAUACAGUAAGCACACA | PS 2'-OMe | IDT |
| TY768-MFSD8-ASO- | CUUUAAAAUGCUUUUAAGGUGGUA | PS 2'-OMe | IDT |
| TY769-MFSD8-ASO-1A | CAGGCUUACAUUUACUCAUCU | PS 2'-OMe | IDT |
| TY770-MFSD8-ASO-1B | GUCAUCGAAGCUUUUCAGG | PS 2'-OMe | IDT |
| TY777-MFSD8ASO-2MOE | AAUGUUAGUGCUUGUUGAGGGC | PS 2'-OMe, 5Me-C, 5Me-U | IDT |
| TY772_22 nt | CGCGACTATACGCGCAATATGC | PS 2'-OMe | IDT |

Fibroblasts of the patient were isolated and cultured to study lysosomal activity and function. Fibroblasts and LCL were transiently transfected with ASOs using Lipofectamine™ 3000 (ThermoFisher) according to the manufacturer's instructions. ASOs were used at 100 nM. Transfected cells were harvested at 24 hours. For dose-response experiments, fibroblasts were transfected by electroporation (Neon Transfection System, ThermoFisher) according to the manufacturer's instructions. ASO were used at concentrations ranging from 1-1000 nM as indicated.

Figure 6A:
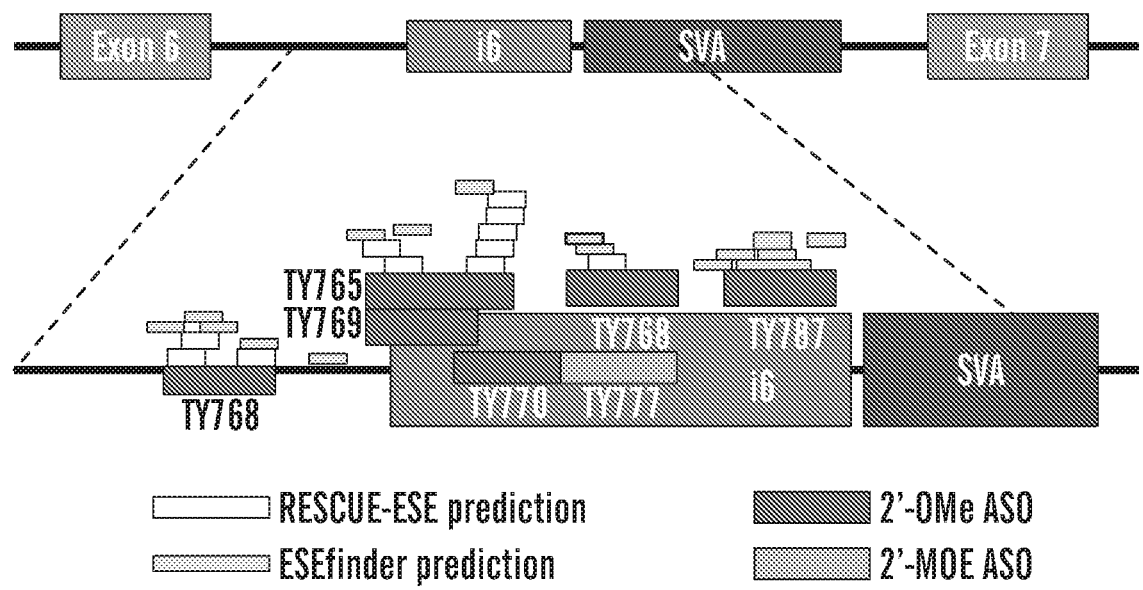
FIG. 6A-6C shows that antisense oligonucleotide screening identified TY777, which effectively rescues exon trapping.
Figure 6B:
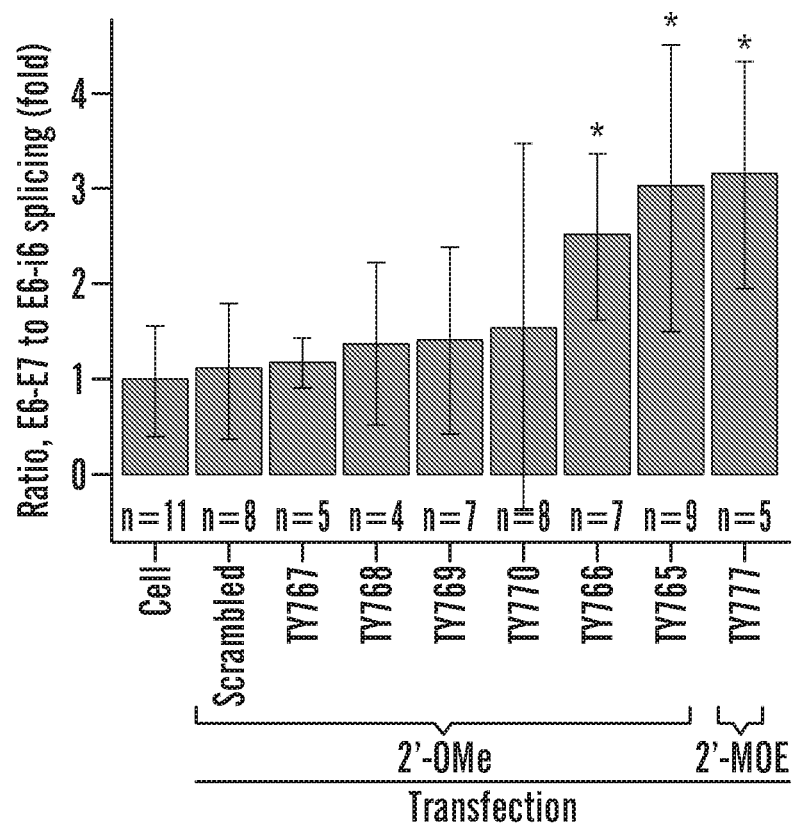
Figure 6C:
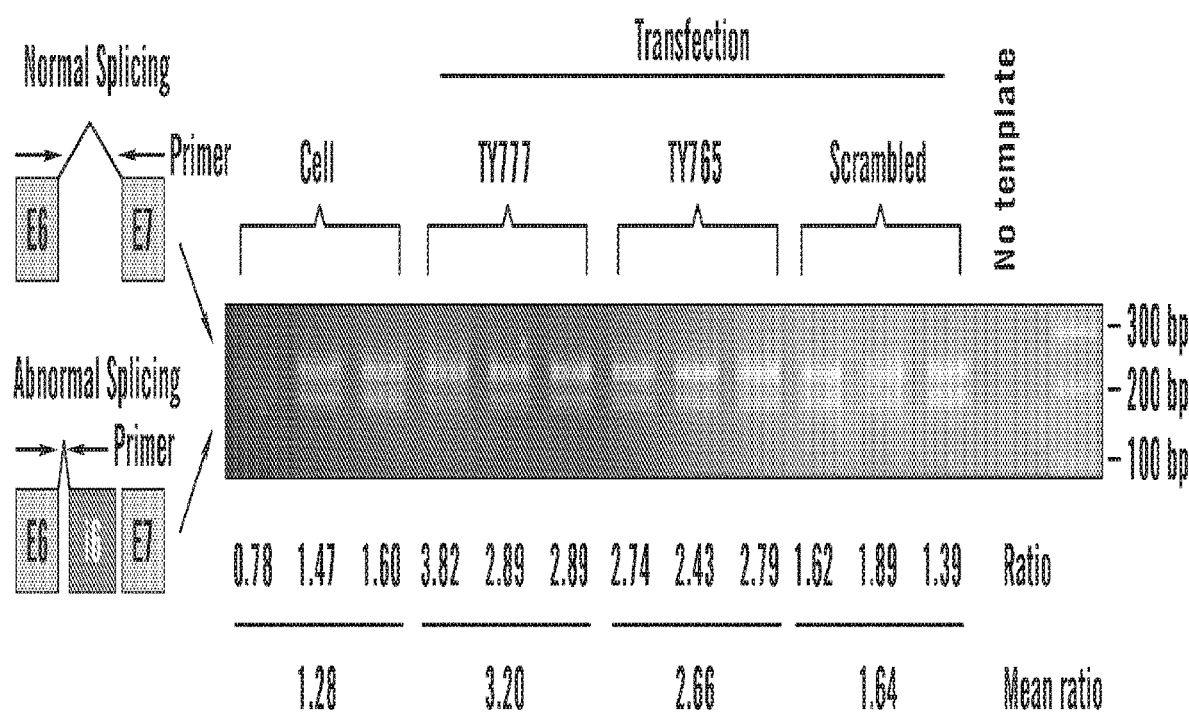
Figure 7:
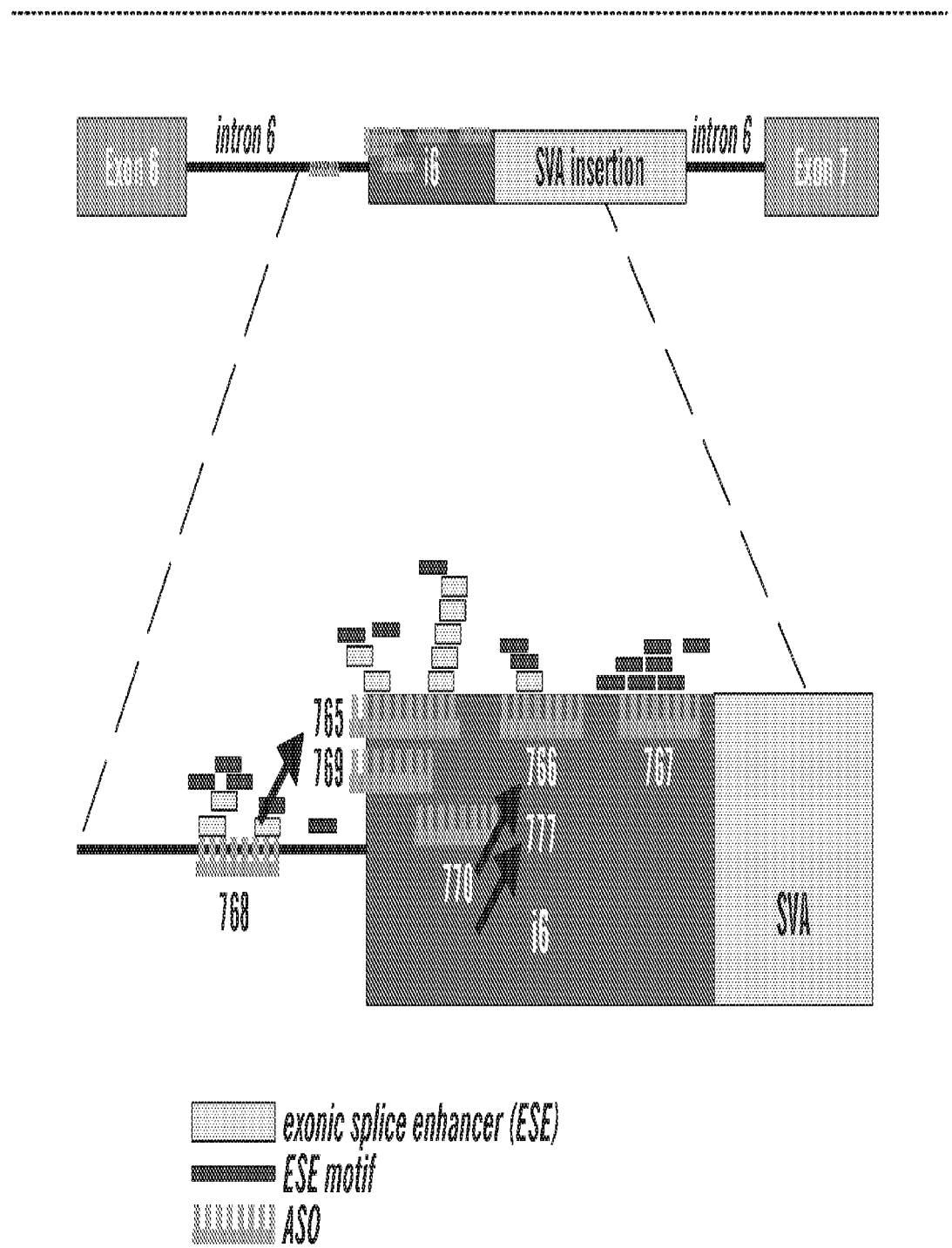
FIG. 7 is a schematic showing the locations where antisense oligonucleotides target the splice acceptor and a downstream site.

After 24 hours, RNA was isolated, and RT-PCR was utilized to assess levels of normal exon 6 to exon 7 vs. abnormal mutant splice product (FIG. 6A). In untransfected cells or cells transfected with a scrambled oligonucleotide control (TY772), the ratio of normal to mutant splice forms ranged around 1:1 (FIGS. 6B and C). An initial screen was conducted using fully phosphorothioated, 2'-OMe-modified oligonucleotides. From this initial screen, two candidates, TY765 and TY766, emerged that significantly increased the ratio of normal:mutant splice ratio by 2.5- to 3-fold in patient fibroblasts (FIG. 6B). TY765 is a 28-nucleotide oligonucleotide that is complementary to a cluster of predicted splice enhancer motifs directly overlying the i6. SA splice acceptor site, while TY766 is a 22-nucleotide oligonucleotide that targets a cluster of predicted splice enhancer motifs 48 bp downstream of the i6.SA site (FIG. 6A). The latter was selected as our lead candidate because its shorter length may help with biodistribution and cellular uptake in vivo. In order to match the chemistry with that of nusinersen—an FDA-approved 18-nucleotide oligonucleotide for spinal muscular atrophy that has shown minimal toxicity—TY777, a fully phosphorothioated, 2'-O-methoxyethyl (PS 2'-MOE) version of the same sequence as TY766 was generated. Similar to TY766, TY777 resulted in 3-fold increase in the ratio of normal to mutant CLN7/MFSD8 splicing (FIGS. 6B, and C).

Figure 8A:
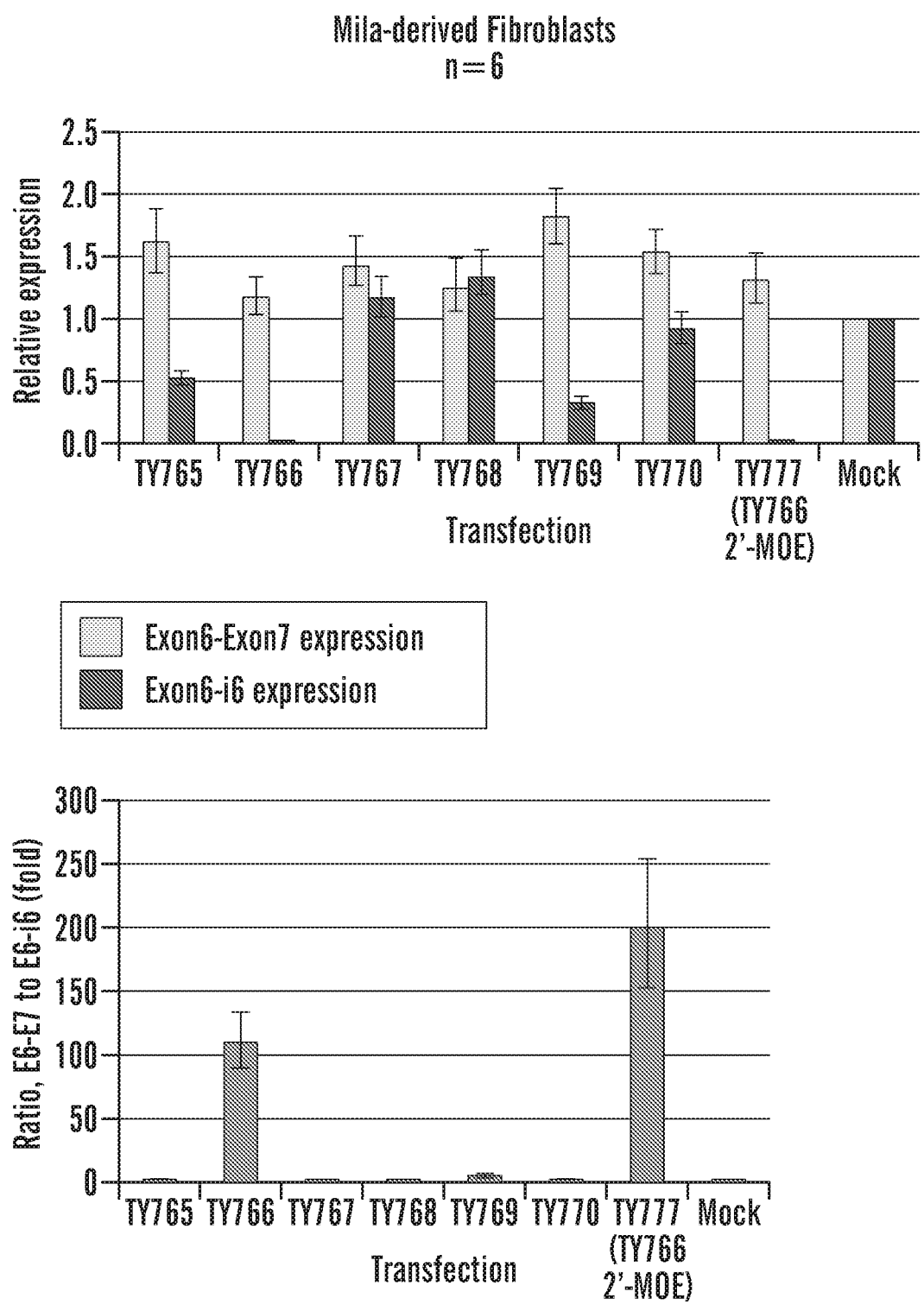
FIGS. 8A and 8B provide graphs depicting the results of a blind experiment conducted by an independent GLP-like laboratory, which confirmed the efficacy of TY777.
Figure 8B:
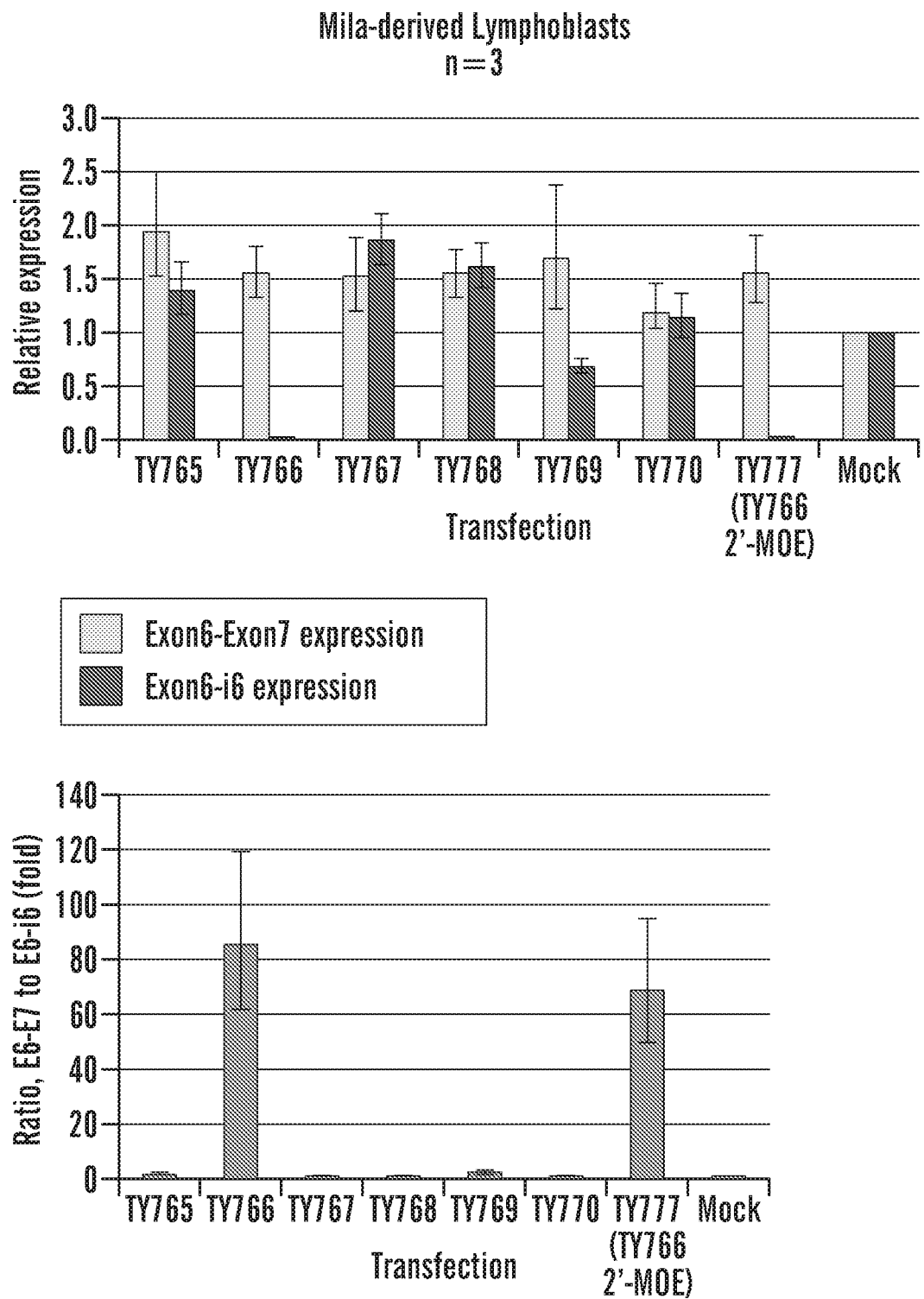
Figure 9:
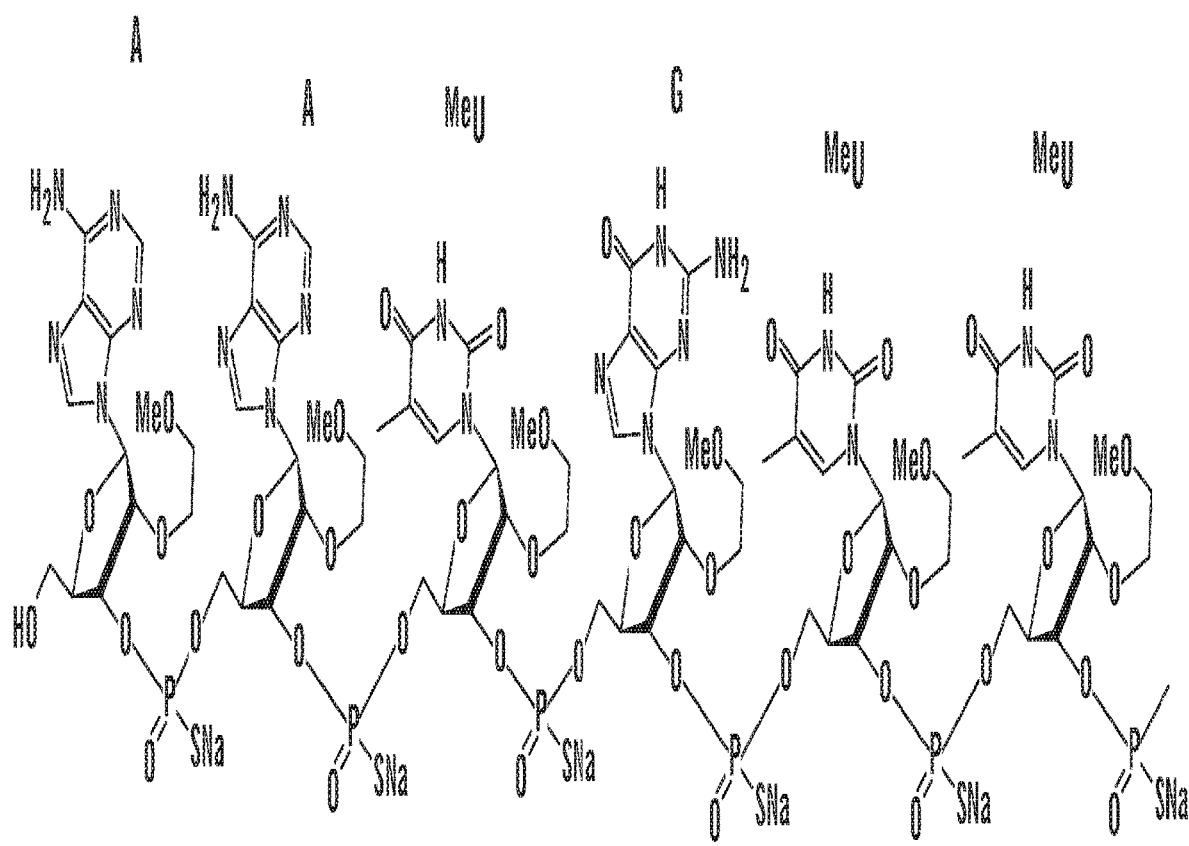
FIG. 9 shows the structural formula of the drug, which is a 22 nucleotide 2'-O-methoxyethyl modified antisense oligonucleotide with complete phosphorothioate backbone (SEQ ID NOS: 2610 and 2610, respectively, in order of appearance).
Figure 9:
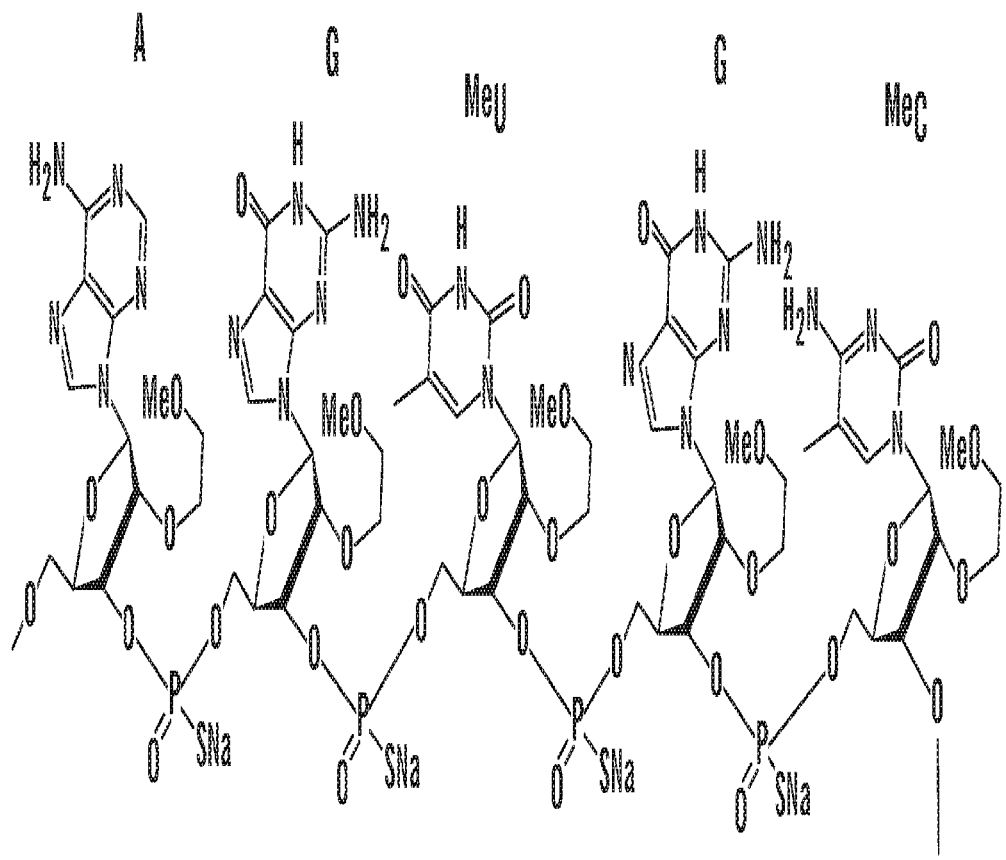
Figure 9:
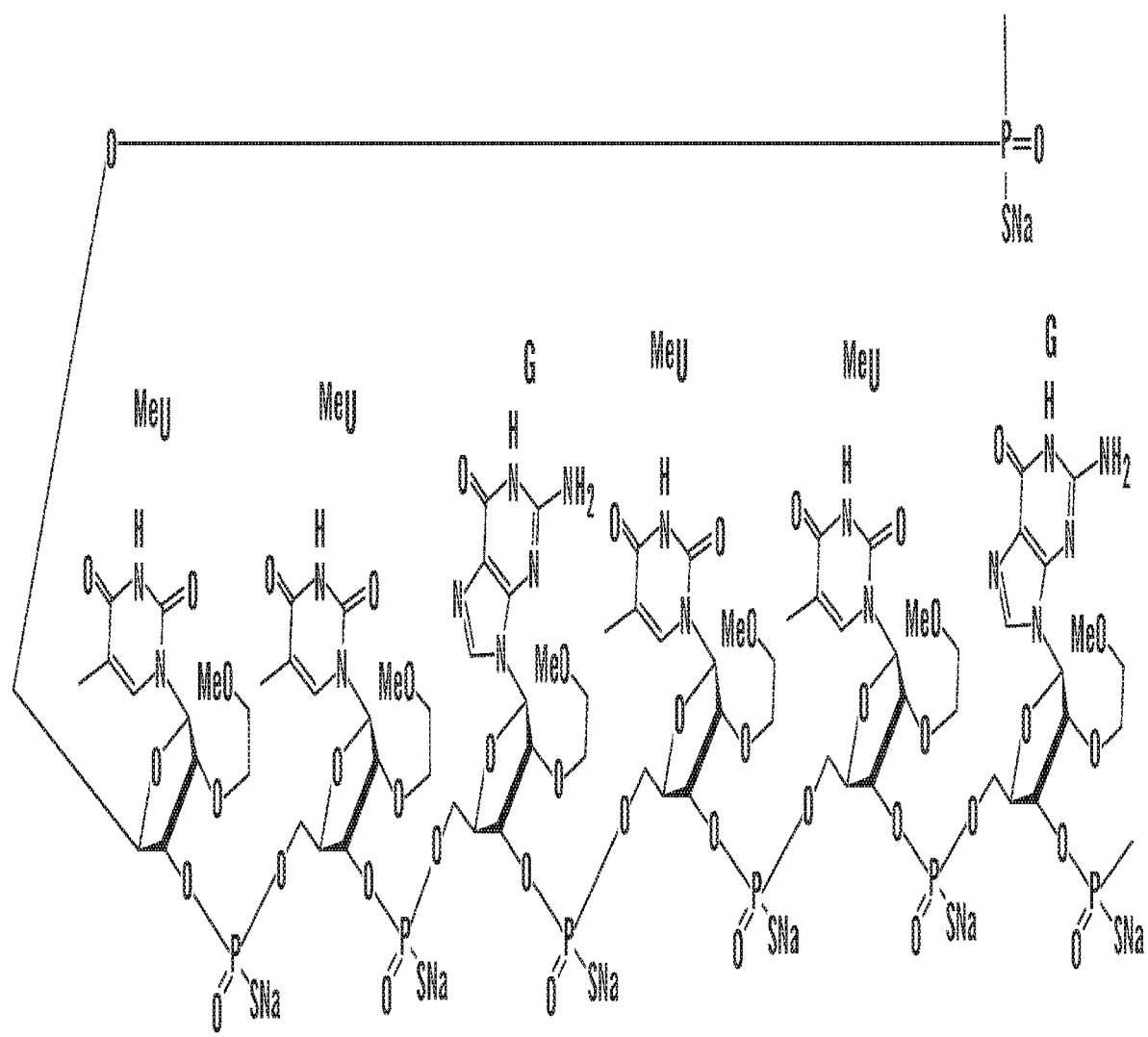
Figure 9:
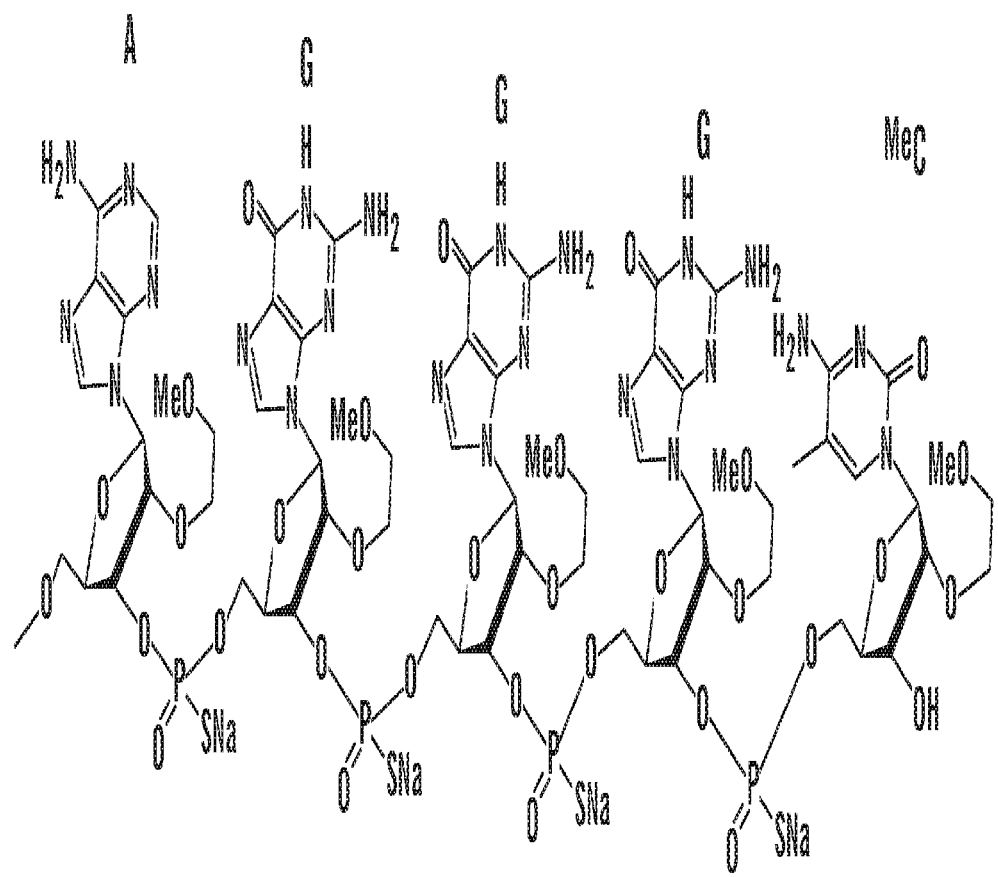
Figure 10:
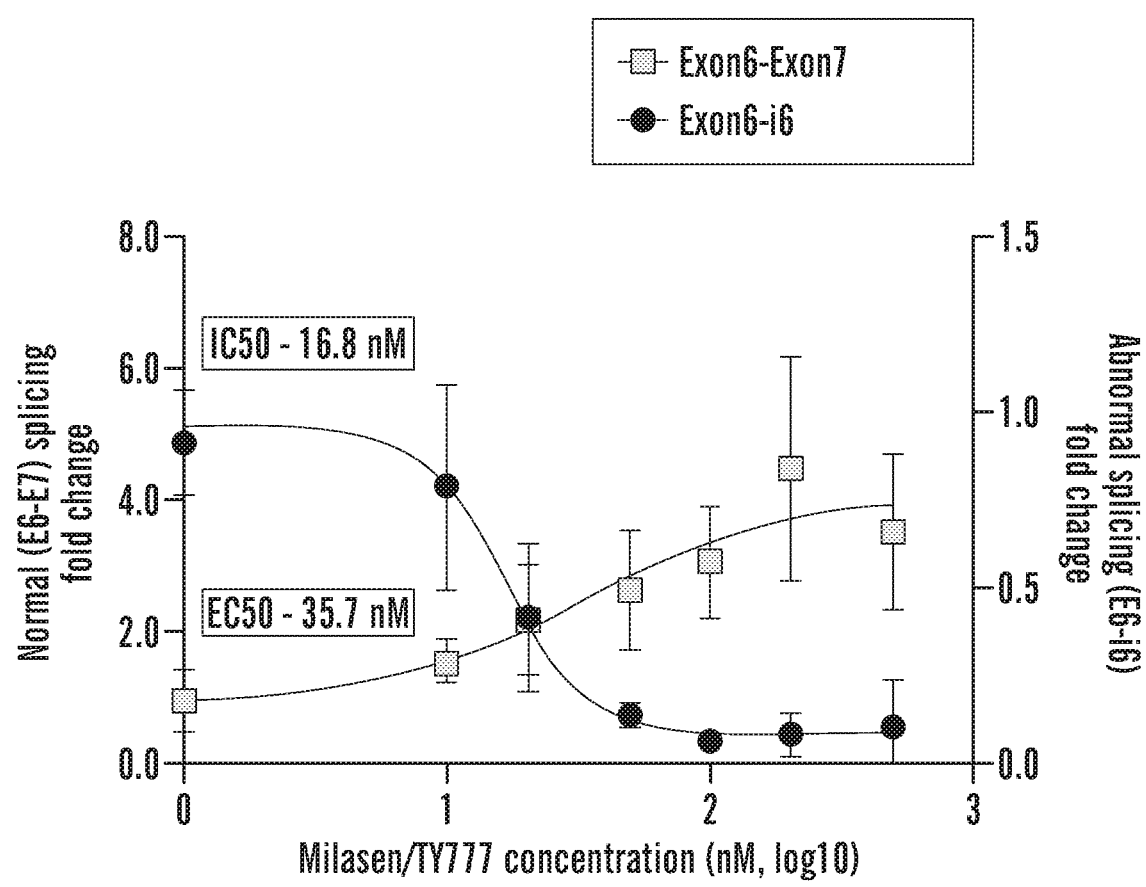
FIG. 10 is a graph depicting results of a quantitative RT-PCR experiments showing milasen/TY777 is effective at nanomolar concentration.

To validate these initial findings, patient cell lines and oligonucleotide reagents were provided to the BCH TransLab. Their blinded experiments replicated the initial findings, not only in patient fibroblasts, but in patient lymphoblasts as well (FIG. 8A, 8B). Consistent with these results, TY766 and TY777 showed the most consistent and largest magnitude level of splice correction. TY777 became the lead candidate for compassionate use for the patient. It was renamed it milasen/TY777.

strated a half-maximal inhibitory effect (IC50) on abnormal exon 6 to i6.SA splicing at ~17.4 nM, and a half-maximal effective concentration (EC50) of ~36.9 nM in terms of activation of normal exon 6 to exon 7 splicing (FIG. 10). These values are similar to those obtained in early proof of concept studies with antisense oligonucleotides targeting SMN2. These data also indicate that the potency of milacin/TY777 meets previously suggested criterion (EC50 less than 100 nM in a cellular assay) for preclinical antisense oligonucleotide candidates.

Figure 11:
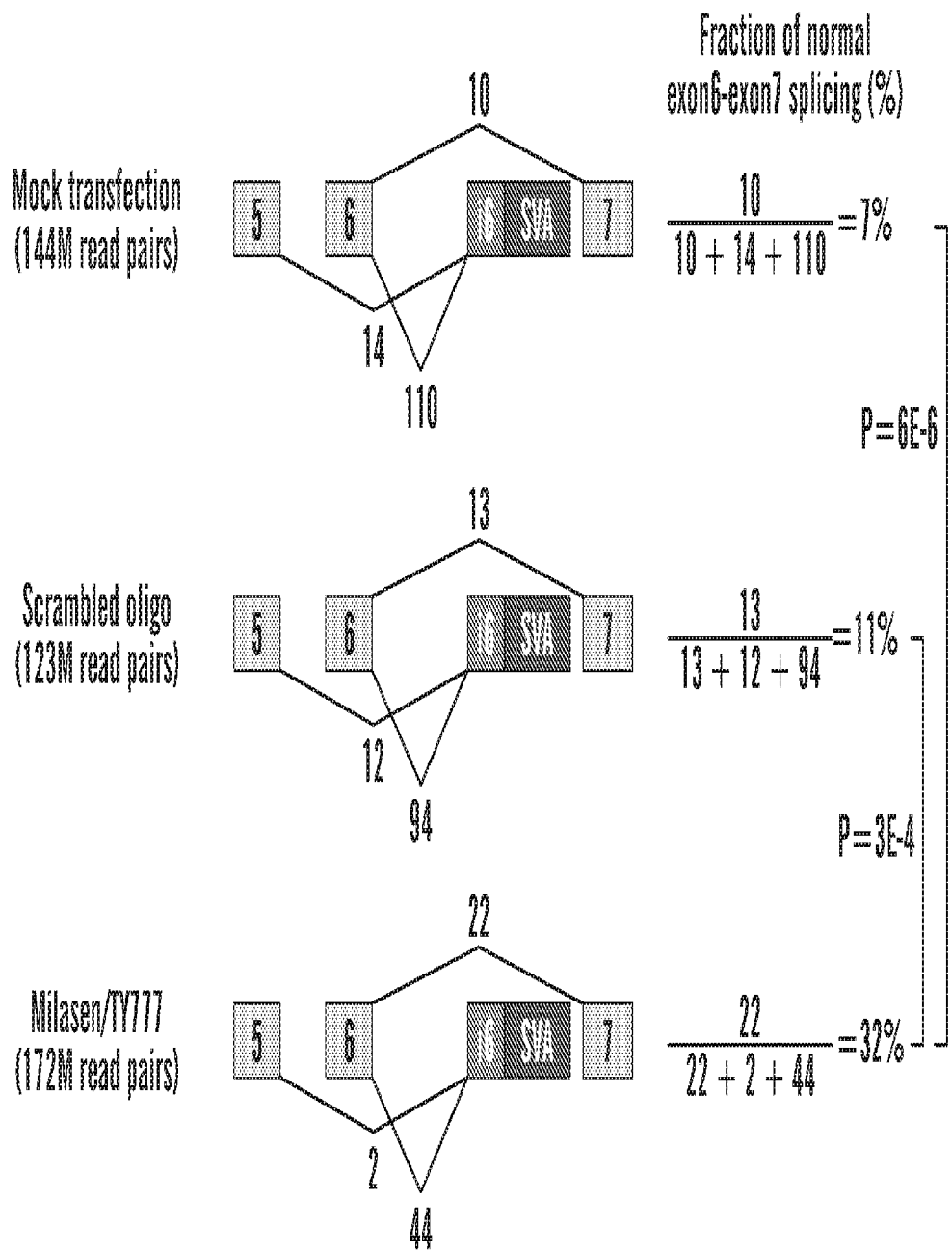
FIG. 11 is a diagram showing that RNA-seq analysis confirms the splice-correcting effect of milasen/TY777. Chi-Square Test of Independence was used for assessing statistical significance.

As additional confirmation, RNA-seq was carried out of polyA+ RNA isolated from untransfected, mock-transfected, and milasen/TY777-transfected patient fibroblasts (FIG. 11). Transfection with milasen/TY777 at 100 nM concentration boosted normal exon 6 to exon 7 splicing to 32% of local splice junctions, compared to 7-11% from mock-transfected patient fibroblasts or those transfected with a scrambled oligonucleotide (p<0.001 for both comparisons, Chi-Square Test) (FIG. 11).

In silico sequence analysis of Milasen/TY777 demonstrated absence of predicted off-target binding sites. Since off-target binding of an oligonucleotide can lead to side effects and toxicity, potential off-target binding sites of milasen/TY777 in the human genome were examined. To simulate binding of end-degraded oligonucleotide products or partial binding of an intact oligonucleotide with a few nucleotide mismatches at either end, BLAST was used to map progressively smaller subsequences of milasen/TY777 to the human reference sequence (GRCh38/hg38; FIG. 12).

Milasen/TY777 did not have any off-target matches to the genome until it is trimmed down by 6 nucleotides (down to a 16-mer), whereas nusinersen, an FDA approved drug with minimal side effect or toxicity, started to have off-target matches when trimmed down by only 1 nucleotide (down to 17mer). This analysis illustrates that milasen/TY777 is likely to have a comparable or smaller off-target binding footprint on the human genome.

Figure 13A:
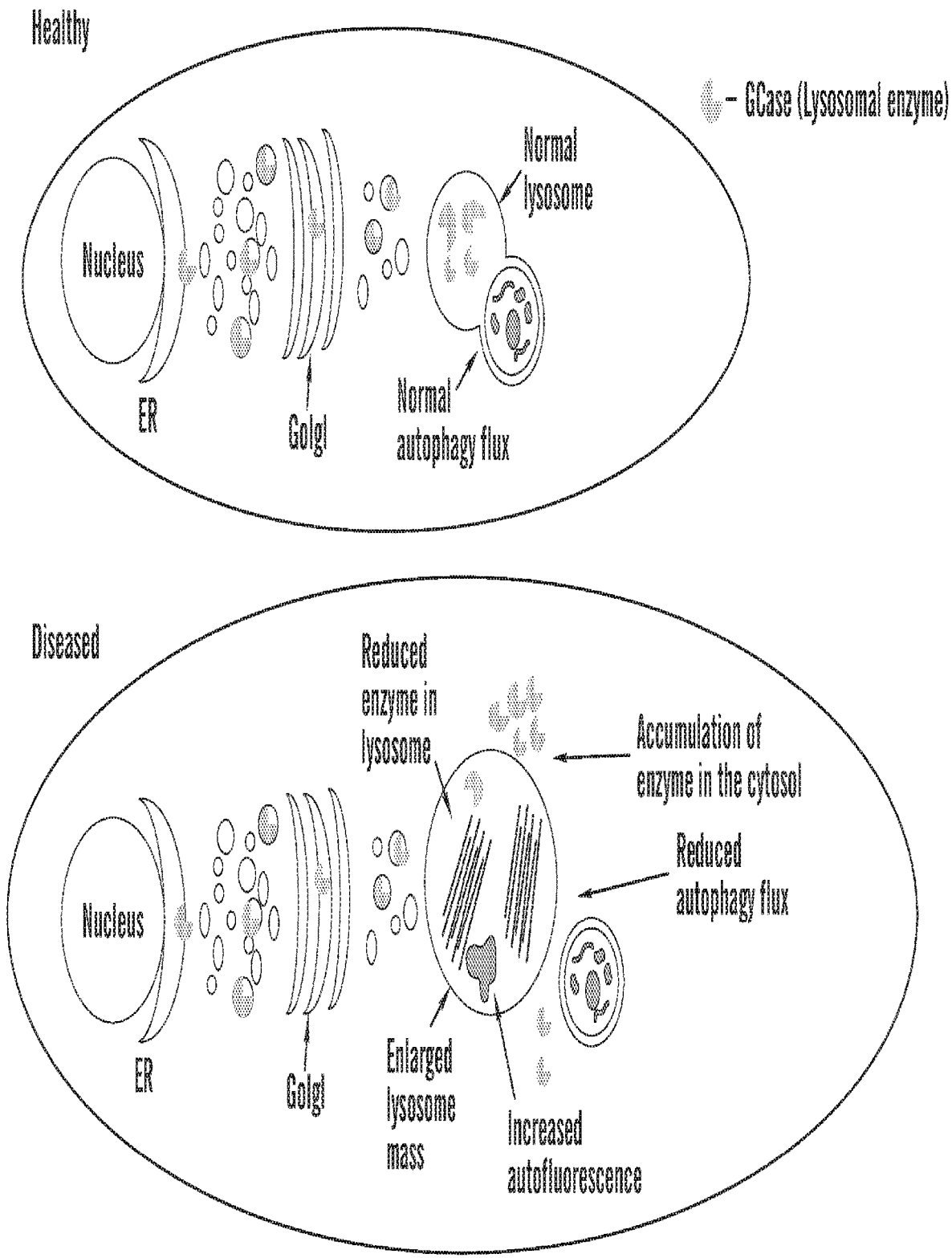
FIG. 13A provides readouts of lysosomal function assays, reflecting healthy (top) and diseased (bottom) cellular states.
Figure 13B:
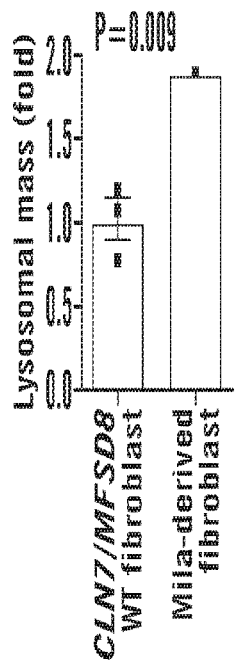
FIGS. 13B, FIG. 13C, FIG. 13D, FIG. 13E, and FIG. 13F are graphs showing differences in lysosomal function between the subject-derived fibroblast and CLN7/MFSD8 wild type fibroblast cells (BJ1). P values were calculated using one-sided Student's T test.
Figure 13C:
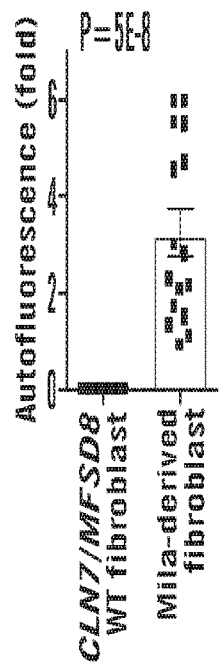
Figure 13D:
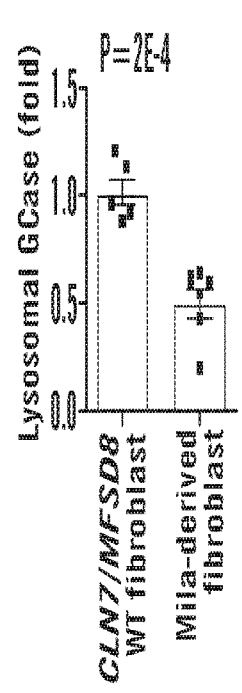
Figure 13E:
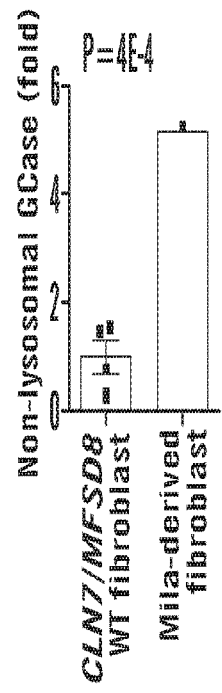
Figure 13F:
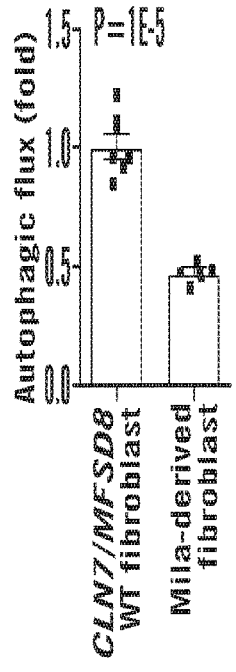
Figure 13G:
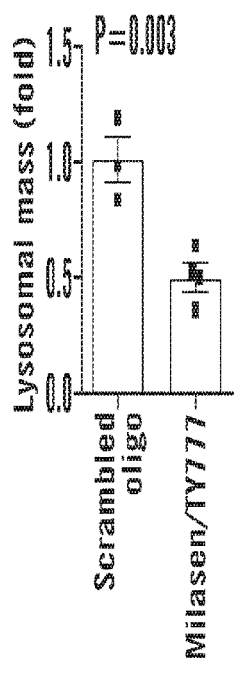
FIG. 13G, FIG. 13H, FIG. 13I, FIG. 13J, and FIG. 13K graphically illustrate the differences in lysosomal function between the subject-derived fibroblasts treated with scrambled oligonucleotide (TY772) and with milasen/TY777.
Figure 13H:
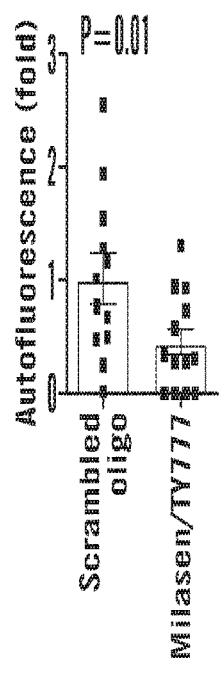
Figure 13I:
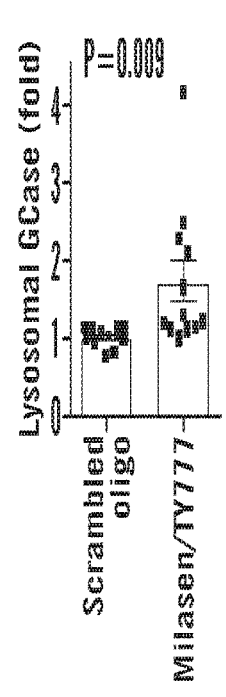
Figure 13J:
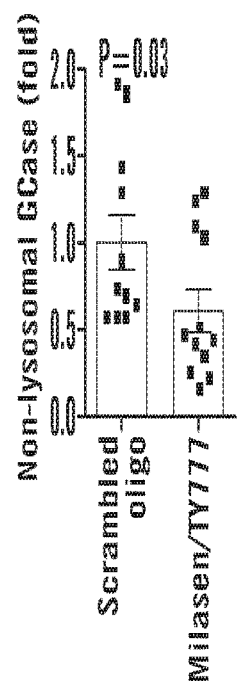

Example 2: Antisense Oligonucleotides Improved Lysosomal Function in a Fibroblast NCL Model The subject's fibroblasts exhibited several cellular phenotypes (FIG. 13A-K) characteristic of lysosomal dysfunction. Subject's fibroblasts showed double the typical lysosomal mass relative to controls (FIG. 13B), consistent with the increase in lysosomal number and size seen in many lysosomal storage disease states. the subject's fibroblasts also demonstrated a strong autofluorescence signal not seen in controls (FIG. 13C), a well-documented observation in neuronal ceroid lipofuscinosis that is associated with functional backup of lysosomes leading to accumulation of lipid and protein aggregates. Finally, the subject's fibroblasts possessed a 40% reduction in enzymatic hydrolase activity within lysosomes (FIG. 13D), but a 5× increase in hydrolase activity within the cytosol (i.e. outside of lysosomes; FIG. 13E), demonstrating a breakdown in proper compartmentalization of lysosomal hydrolases. Lastly, the subject's fibroblasts showed reduced autophagic flux, consistent with lysosomal dysfunction (FIG. 13F).

Figure 13K:
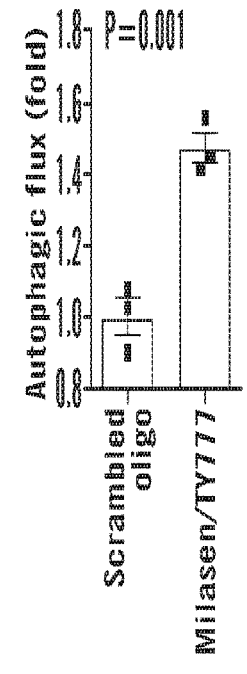
Figure 14A:
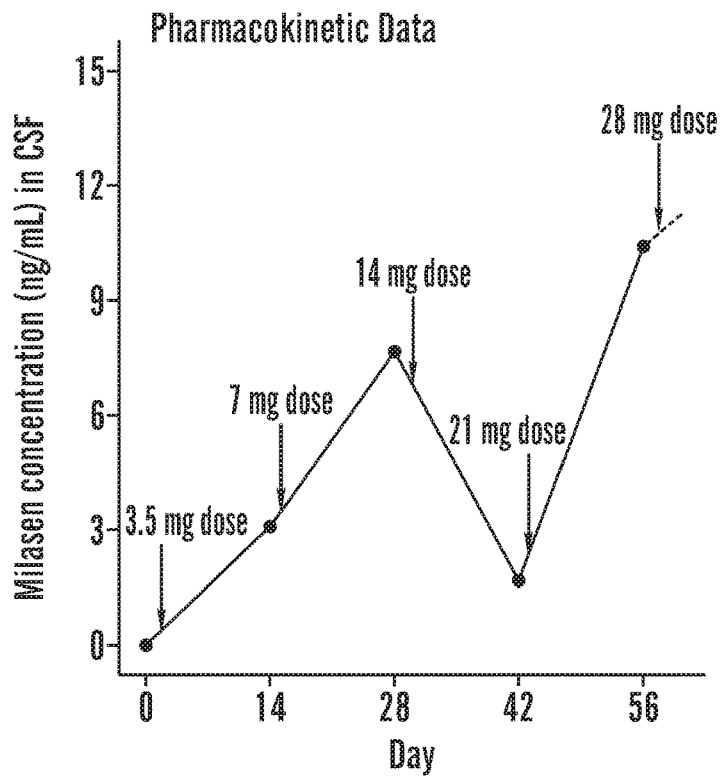
FIG. 14A and FIG. 14B show Milasen concentration in cerebrospinal fluid (CSF) and plasma, respectively, at various time points.
Figure 14B:
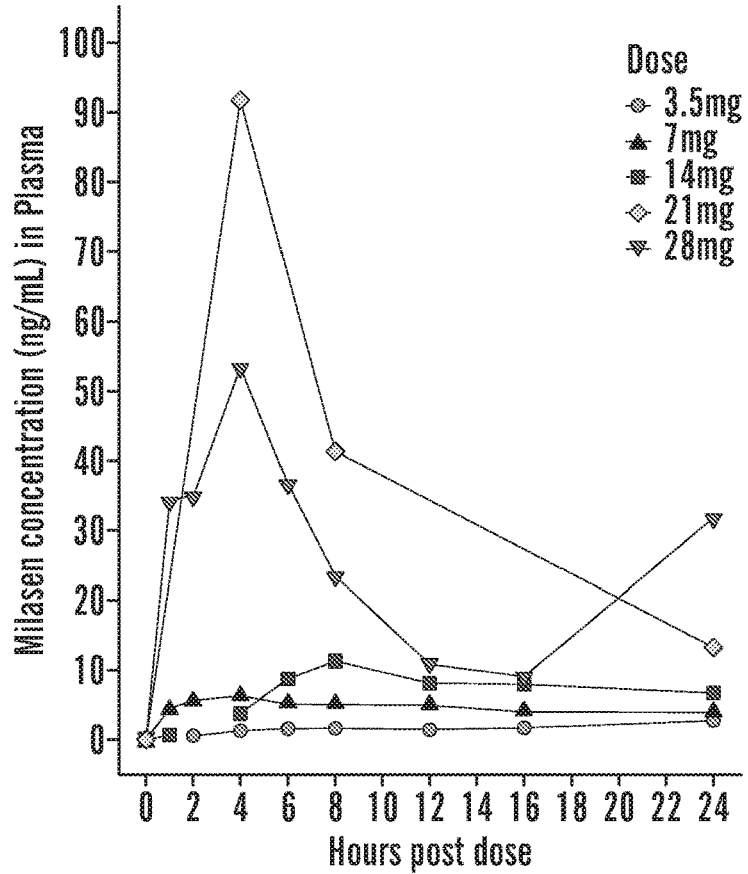
Figure 15:
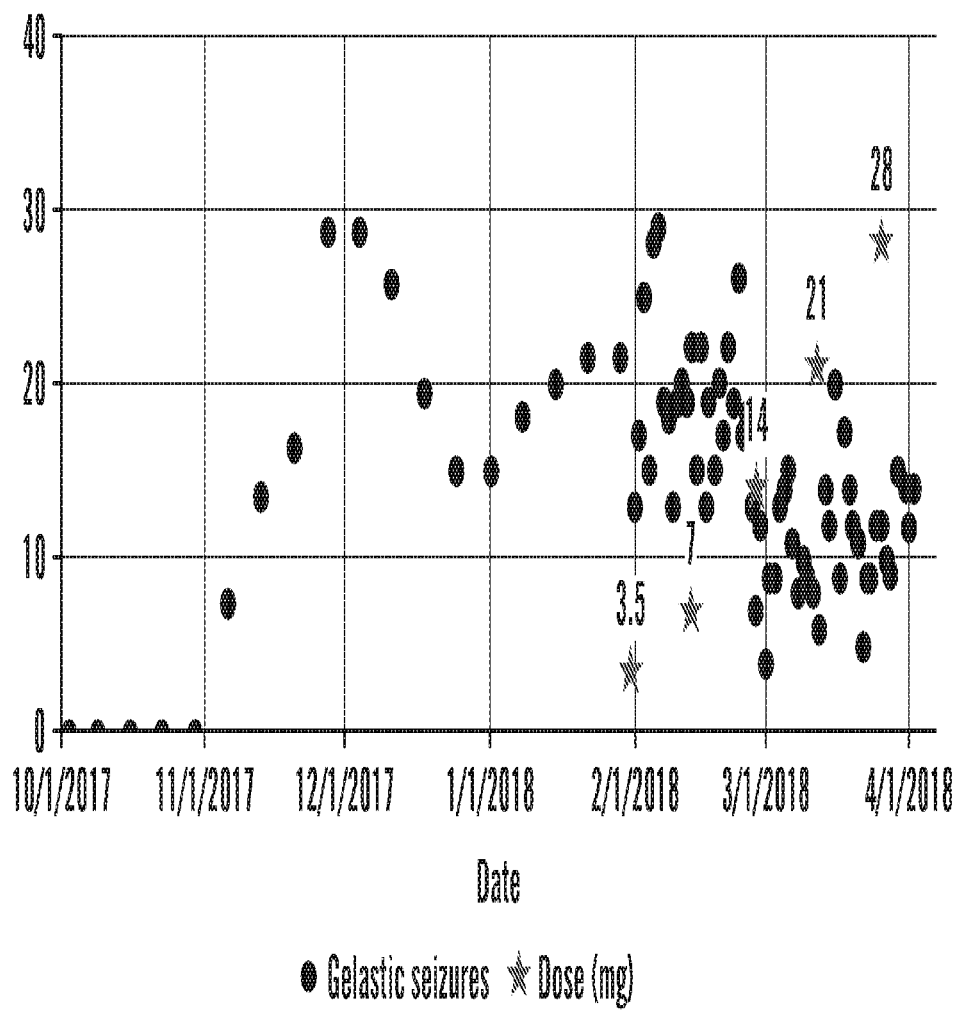
FIG. 15 shows changes in daily seizure frequency in the subject over time.
Figure 16:
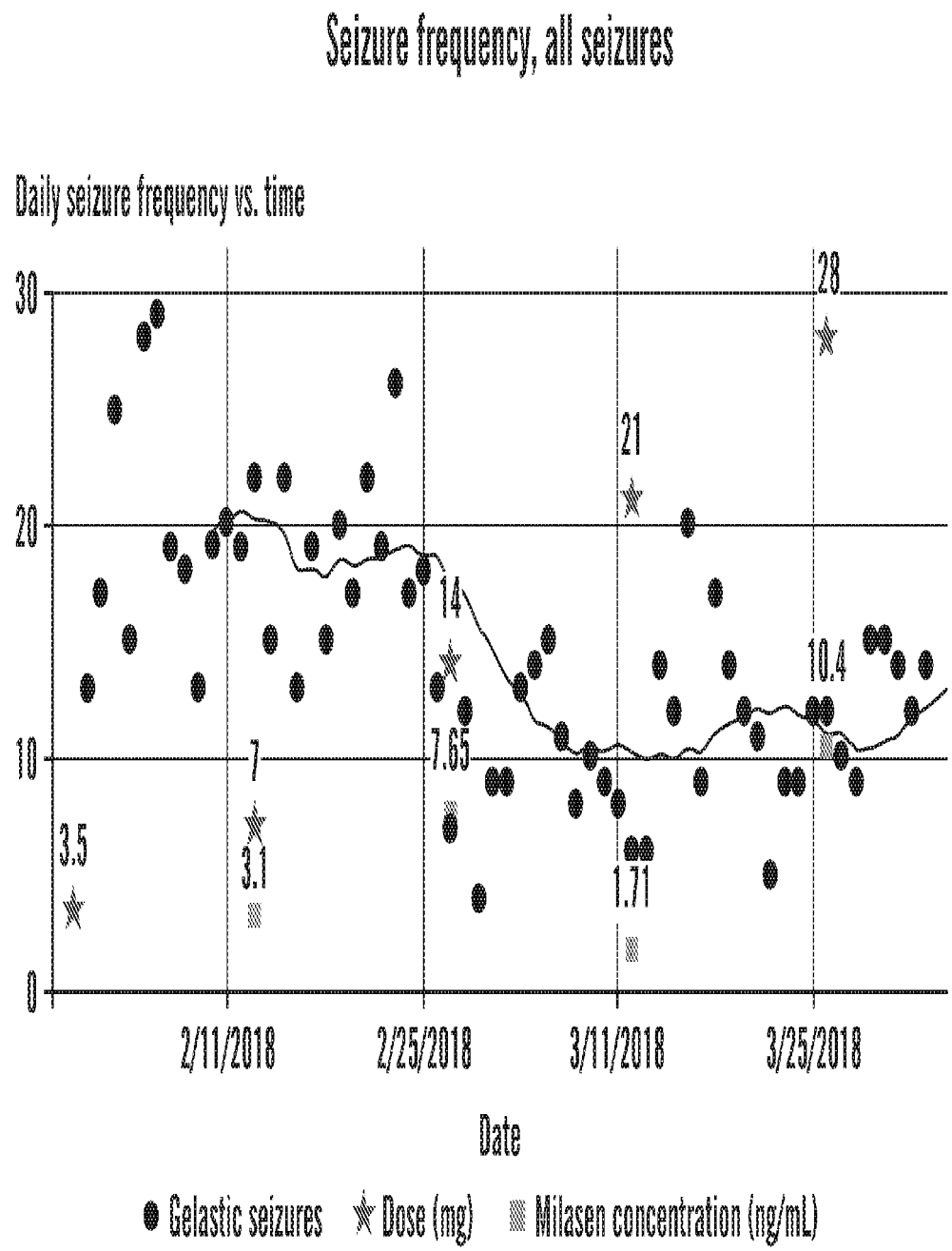
FIG. 16 shows changes in seizure frequency over time.
Figure 17:
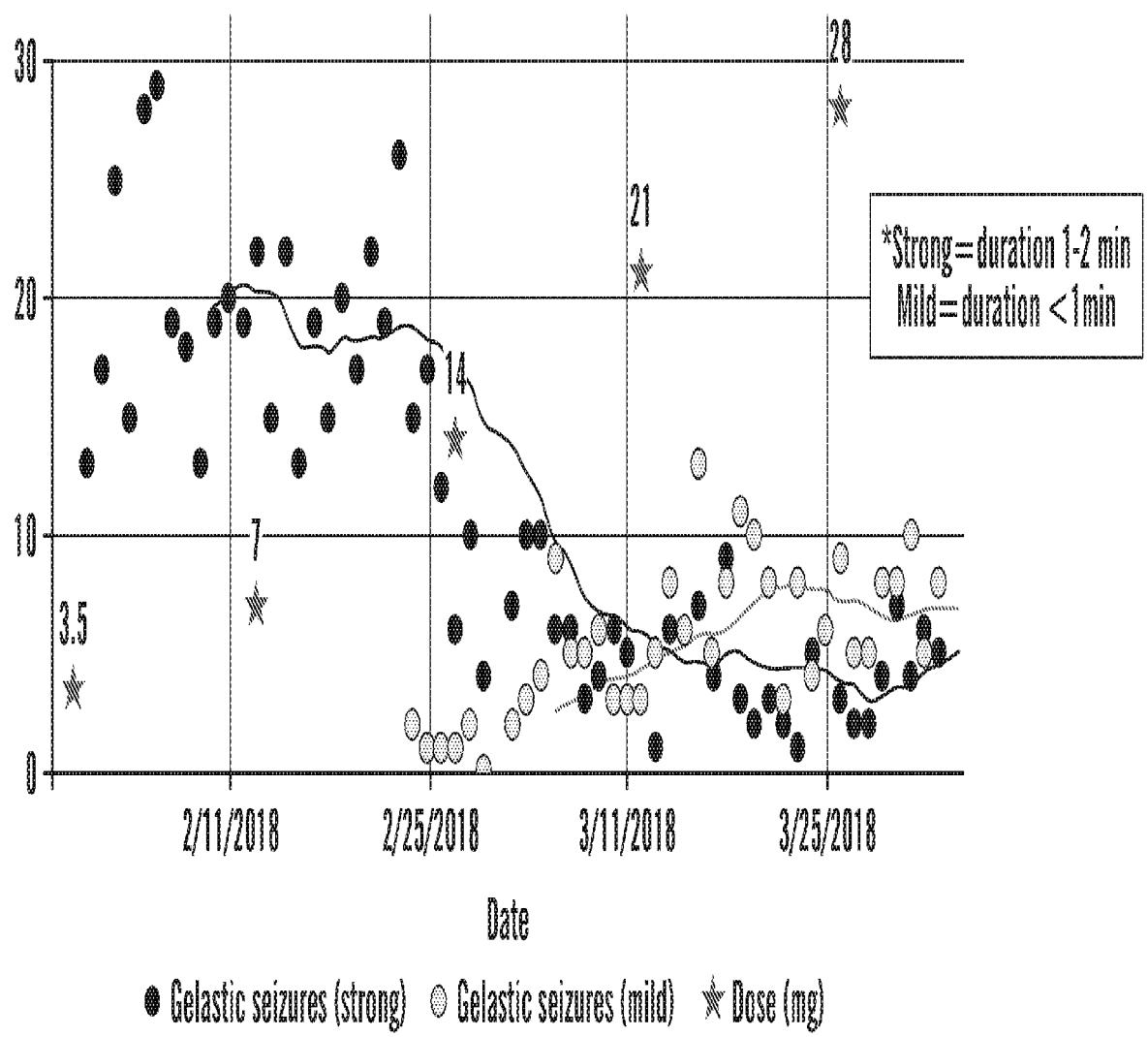
FIG. 17 shows changes in the frequency of strong and mild seizures over time.

Transfection of fibroblasts with milasen/TY777 resulted in significant reduction of lysosomal mass (FIG. 13G), significant reduction of accumulation of autofluorescence pigment (FIG. 13H), significant increases in hydrolase activity within lysosomes (FIG. 13I), and a trend, albeit not reaching significance, towards reduction in hydrolase activity outside of lysosomes (FIG. 13J), and significant restoration of autophagic flux (FIG. 13K). Together, these results provided evidence that oligonucleotide treatment of the subject's cells would not only improve normal splicing but also restore cellular lysosomal function.

Together, these results demonstrate that the subject harbors an intronic SVA retrotransposon insertion that causes abnormal splicing and exon trapping of CLN7/MFSD8, and provides encouraging evidence that antisense oligonucleotide treatment with TY777/milasen can not only restore normal splicing but also restore cellular lysosomal function.

Example 3: Toxicology

Toxicology was assessed in Sprague-Dawley rats, which are commonly used for intrathecal dosing and tolerate implanted catheters for redosing on longer term studies with few catheter failures or infections. They are sensitive to non-sequence related oligonucleotide toxicity and have been extensively used in oligonucleotide toxicity studies; therefore, they are considered sensitive and relevant. Because milasen is designed to suppress an abnormal splice product caused by the subject's unique gene mutation, there are no applicable target mRNA sequences found in any species, so toxicities seen from milasen in any animal species will be non-target mediated in nature, so there would be no added benefit to risk assessment gained from studying milasen in other species. Similar reasoning (of limiting toxicity to only rodents) is used in cases where specifically designed monoclonals target viruses and no target is present in any healthy animals.

The rat high dose of 1 mg delivered by intrathecal delivery was considered a No Observed Adverse Effect Level (NOAEL) This was based on the clinical observations (transient hind limb limitations for 24 h), neurological exams (subtler neurobehavioral effects on hind limbs were present at 24 h, but were resolved fully by 5 d, and 8 d as well), and histopathology (no neuronal toxicity was seen in spinal cord or brain). There were no adverse effects evident from hematology or clinical chemistry assessment panels. Notably, class-related effects seen with intravenously delivered oligos did not occur (such as thrombocytopenia, anticoagulant, or nephrotoxicity); this dovetails with the biodistribution data showing limited systemic exposure as assessed by plasma. The only milasen-associated histopathologic findings were minimal to mild vacuolated inflammatory cells that may contain test article or be responding to a combined inflammatory effect from recent surgery (local tissues are disrupted by catheter implant) and lumbar infusion of a foreign, charged substance into a confined area. The presence of inflammatory cells is considered non-adverse since they are seen at day 8 post dosing (necropsy date), when all hind limb effects had resolved. The hind limb effects alone, were carefully examined at multiple time points and fully resolved, and were not associated with any histopathologic evidence of neuronal degeneration. Hind limb weakness was also reported in monkeys following intrathecal dosing with nusinersen, but these also resolved. Therefore, the weight of evidence suggests these transient hind limb effects are nonadverse; taken together, evidence supports using 1 mg in rat as the basis for covering the safe dose ranges in the human subject.

The rat to human (compartmental) scaling factor was based on estimating the ratio of the highest theoretic concentration at time zero (C0) in the rat and human CSF. C0 (the highest possible concentration immediately post dosing) can be estimated by dividing the delivered mass of drug by the theoretic compartment volume: the highest rat dose (NOAEL) was 1 mg (1000 μg) and dividing by the rat CSF volume (0.300 ml) yields a C0 of 3333 μg/ml. The theoretic C0 instead of the measured CSF value in rats was used because the biodistribution study was very limited in design (due to limited availability of research grade test article) and did not include an immediately-post-dose sacrifice group for obtaining an approximate Cmax. Comparing C0 with the far lower levels seen at 4 hours (3333 vs. 189.1 μg/ml), it seems evident (and consistent with polyphasic pattern of disposition observed with related oligonucleotides) that by 4 hrs, the earliest sacrifice time point, extensive distribution had already occurred primarily into the CNS and cord; very little was distributed to plasma (0.07% was found in plasma at 4 hrs and none thereafter). Therefore, the best basis for rat and human dose comparison is the C0 ratio in CSF for rat and the human subject. To obtain the right scaling factor for the rat and human CSF compartments, the subject's CSF volume was estimated to be 150 ml (a typical volume for her height, weight and age) and rat CSF volume to be 300 μl; rat weights ranged from ~280 to ~320 g so this is a reasonable rat compartment volume estimate. This represents a human/rat CSF volume ratio of 500×. In order to provide a conservative safety margin, and considering that there is no animal model of the subject's unique mutation and Batten Disease/NCL, an estimated starting dose in human was used that offers room for dose escalation and the opportunity to monitor the subject's reactions to drug before escalation. The subject's starting dose was 3.5 mg (several fold lower than nusinersen) which will yield an estimated C0 (3500 μg/150 ml), or 23 μg/ml. Compared to 3333 μg/ml at the NOAEL in rats, this is a safety margin (rat/human CSF; C0 concentration ratio) of 142×. Subsequent doses (7 mg and 14 mg) are planned at two week intervals to provide time for gathering safety and efficacy data because the target site of action for the subject is in the brain, and not directly in the spinal cord as in the case for nusinersen and SMA.

TABLE 3

| Rat | Human | Estimated C0 |
|---|---|---|
| 0.007 mg | 3.5 mg | 23 μg/mL |
| 0.014 mg | 7 mg | 47 μg/mL |
| 0.028 mg | 14 mg | 93 μg/mL |
| 0.06 mg * | 30 mg | 200 μg/mL |
| 0.25 mg * | 125 mg | 833 μg/mL |
| 1.0 mg *† | 500 mg | 3333 μg/mL |

* tested; see section 7.1.1. Study No. 5500241 and Section 7.3.1. Study No. 5500230
† rat intrathecal NOAEL Dose escalation over time allows for the possibility to explore saving the subject from further decline, possibly reversing some of the more recent losses in function, and giving her only treatment option the best opportunity to work. Further doses escalations are planned if the subject tolerates the drug, but beyond the dose series of 3 doses over 6 weeks.

Example 4: Therapeutic Administration of Antisense Oligonucleotides Shows Efficacy in Human Subject Additional primers (see below) were designed against sequences within CLN7/MFSD8 and the SVA transposon insertion and used to detect normal and abnormal CLN7/MFSD8 splice products (35 cycles, 98° C. for 5 s, 60° C. for 15 s, and 72° C. for 15 s) using 1 μL of cDNA prepared from patient and family member samples. GAPDH and 18S RNA were used as loading controls. For quantification experiments, primers TY715, TY758, and TY759 were used in competitive multiplex PCR.

TY715/TY759 amplify a 233 bp band representing wild-type splicing between exons 6 and 7, whereas TY715/TY759 amplify a 190 bp band representing abnormal splicing between exon 6 and cryptic exon i6. Relative quantities of wild-type and abnormally spliced products were calculated using 2% agarose gel electrophoresis, staining, and densitometry analysis (ImageJ). The primers and probes used in RT-PCR assays are shown in the following table:

TABLE 4

| Primer name | Sequence |
|---|---|
| TY714-MFSD8-RT-F2 | TCTCAGCAGTGTAGGGTTTTCT |
| TY715-MFSD8-RT-F3 | TGGAGGAGGAAATGTAGCAGTT |
| TY734-MFSD8-Exon7-R1 | TCACATCCCATGTCACACCT |
| TY743-18S-RNA-RT-F1 | CATTCGAACGTCTGCCCTAT |
| TY744-18S-RNA-HT-R1 | CAATTACAGGGCCTCGAAAG |
| TY747-GAPDH-RT-F1 | GAGTCAACGGATTTGGTCGT |
| TN748-GAPDH-RT-R1 | TTGATTTTGGAGGGATCTCG |
| TY758-MFSD8-I6-R | TGTTAGTGCTTGTTGAGGGCT |
| TY759-MFSD8-E7-R | ATTCCCAGGAAGGCGCTAAG |

Quantitative RT PCT

RNA samples were analyzed by RT-qPCR (Comparative Cτ (ΔΔCτ) assay). Two assays (primers/probe sets) were used to amplify abnormal E6-i6 and normal E6-E7 exon junctions. GAPDH was used as an internal control. Untransfected cell samples were used as a reference samples for final ΔΔCτ calculations. Primers and probes used in the TaqMan™ assays are shown in the table below:

TABLE 5

| Primer name | Sequence | Probe label | Amplicon size (bp) |
|---|---|---|---|
| MFSD8-E6-i6-fwd | AGCATGTGTCAAGCATTAGGT | FAM | 101 |
| MFSD8-E6-i6 rev | AGTGCTTGTTGAGGGCTTATT | | |
| MFSD8-E6-i6 probe | AGGTCCAGATGAGTAAATGTAAGCCTGA | | |
| MFSD8-E6-E7 fwd | ACATAAGCATGTGTCAAGCATTAG | FAM | 150 |
| MFSD8-E6-E7 rev | CCAGGAAGGCGCTAAGTAAA | | |
| MFSD8-E6-E7 probe | AGGTGTGACATGGGATGTGATTAAACTGC | | |
| GAPDH fwd | GGTGTGAACCATGAGAAGTATGA | VIC | 123 |
| GAPDH rev | GAGTCCTTCCACGATACCAAAG | | |
| GAPDH probe | AGATCATCAGCAATGCCTCCTGCA | | |

The present invention provides one or more antisense oligonucleotides that are useful to induce skipping of a deleterious exon associated with the insertion of a retrotransposon into a gene. In particular embodiments, an antisense oligonucleotide targets SVA or a fragment thereof. Antisense oligonucleotides targeting the retrotransposon or a mutation introduced by the retrotransposon are useful for the treatment of diseases or disorders associated with the presence of a deleterious mutation at one allele of a gene and a retrotransposon insertion that disrupts the corresponding allele.

Example 5: Therapeutic Effects of Anti-Sense Oligonucleotide Therapy

In November 2016, the subject, a seven year old girl, was diagnosed with a form of Batten disease. Within a year of being diagnosed, she went from playing independently to walking with assistance. Her language has deteriorated, and in September 2017, she had a G-tube placed to maintain her nutritional status in the face of increasing difficulty swallowing. Her seizure frequency has also increased. In an effort to preserve her intelligence and personality, anti-sense oligonucleotide development was undertaken to determine whether blockade of splicing from exon 6 to i6.SA with an antisense oligonucleotide could restore normal CLN7/MFSD8 RNA processing and improve lysosomal functioning.

Milasen consists of a 22 nucleotide oligonucleotide with 2'-O-methoxyethyl modified bases and a full phosphorothioate. It utilizes the same chemistry as the recently approved oligo, nusinersen, a well-tolerated and highly similar oligo that is injected directly into spinal fluid of infants and children with SMA. Milasen only differs in sequence and slightly in length (22 nucleotides for milasen vs 18 for nusinersen). This is the common length for oligo drugs because the length is sufficient to ensure avid and specific binding to only one site in the subject's genome. These synthetic oligo agents do not integrate into, or otherwise directly alter, the subject's DNA itself—they interact with the CLN7/MSD8 nuclear RNA transcript, only at the RNA site where her splice defect is exhibited. Because her genome was sequenced, it was determined that there are no other sites which can bind Milasen. Thus, milasen is a selective agent that can correct SVA transposon-induced splicing defect. Substantial oligonucleotide drug levels in brain can be achieved by lumbar intrathecal administration (Finkel et al., Lancet 388, 3017-3026, 2016).

Milasen will be supplied as a 2 mL vial containing 8.46 mg/mL milasen. Prior to injection, milasen will be diluted with Elliott's B to the indicated dosage level to an injection volume of 5 mL per dose administered intrathecally.

Milasen is being administered using a dose escalation period followed by a loading phase and a maintenance phase. Doses of 3.5 mg, 7 mg, and 14 mg, each spaced two weeks apart, were used initially. The subject undergoes 48 hours of inpatient observation after each dose. During this phase, blood and CSF samples have been drawn for pharmacokinetic (PK) assessments. CSF samples were withdrawn immediately prior to each dose administration, with samples collected on Day 0, Day 14, Day 28, and Day 42. Also, at each dosage level, blood samples were drawn pre-dosing, immediately post dose, and at 1, 2, 4, 6, 8, 12, 16, and 24 hours post-dosing.

The subject is showing improvement in response to treatment. Prior to treatment, the subject has between 15-25 seizures per day. Daily seizure activity and overall frequency is trending downward following initiation of therapy. Seizure severity is also trending downward. Following the $4^{th}$ dose of Milasen, the subject was having about 10 seizures per day.

Four months after initiation of treatment, the subject had her first seizure free day.

The results described herein were obtained using the following methods and materials.

Skin Fibroblast Derivation, Lymphoblastoid Cell Line (LCL) Generation, and Maintenance Fibroblasts Patient skin fibroblasts were derived from 3 mm skin punch biopsy by explant culture. Fibroblasts were maintained and passaged in media containing Alpha MEM (Irvine Scientific), Chang Medium B (Irvine Scientific), and supplemented with Chang C Supplement (Irvine Scientific), GlutaMAX™ (Life Technologies) and 10% fetal bovine serum (FBS) (Life Technologies). Fibroblasts used in experiments were under passage 20.

Lymphoblastoid Cell Lines (LCL)

5 ml peripheral blood from each donor (Proband, Mother, Father and Brother) were drawn into a heparinized blood tube. Mononuclear cells (MNC) were isolated by density gradient centrifugation using Ficoll Histoplaque®-1077 (Sigma-Aldrich). LCL were established by infecting MNC with Epstein-Barr Virus (EBV). LCL were established in 2-4 weeks and maintained in RPMI 1640 (Caisson Lab) supplemented with 10% FBS (Life Technologies).

Transfection

Fibroblasts and LCL were transiently transfected with ASOs using Lipofectamine™ 3000 (ThermoFisher) according to the manufacturer's instructions. ASOs were used at 100 nM. Transfected cells were harvested at 24 hours. For dose-response experiments, fibroblasts were transfected by electroporation (Neon Transfection System, ThermoFisher) according to the manufacturer's instructions. ASO were used at concentrations ranging from 1-1000 nM as indicated. Transfected cells were harvested at 24 hours.

RNA Extraction and cDNA Synthesis

Two methods were used for RNA isolation and cDNA synthesis: Total RNA was isolated using Pure Link™ RNA mini kits (Life Technologies) according to the manufacturer's instructions. cDNA synthesis using oligo-dT was performed with the Super Script II reverse transcriptase kit (Invitrogen) according to the manufacturer's instructions.

Alternatively, total RNA was purified using RNeasy® Plus Mini Kit (Qiagen) according to the manufacturer's instructions. cDNA synthesis was performed in concert with RT-qPCR using gene-specific primers and gScript™ XLT One-Step RT-qPCR ToughMix®, Low ROX™ kits (VWR Quanta Biosciences™).

RT-PCR

Primers (see below) were designed against sequences within CLN7/MFSD8 and the SVA transposon insertion and used to detect normal and abnormal CLN7/MFSD8 splice products (35 cycles, 98° C. for 5 s, 60° C. for 15 s, and 72° C. for 15 s) using 1 μL of cDNA prepared from patient and family member samples. GAPDH and 18S RNA were used as loading controls. For quantification experiments, primers TY715, TY758, and TY759 were used in competitive multiplex PCR. TY715/TY759 amplify a 233 bp band representing wildtype splicing between exons 6 and 7, whereas TY715/TY759 amplify a 190 bp band representing abnormal splicing between exon 6 and cryptic exon i6. Relative quantities of wildtype and abnormally spliced products were calculated using 2% agarose gel electrophoresis, staining, and densitometry analysis (ImageJ).

Dose Response Curve

Dose-response curves, EC50, and IC50 values were calculated and plotted with Prism software (Graphpad).

RNA-Seq

RNA-seq libraries were prepared using WaferGen PrepX kit (WaferGen Biosystems). Sequencing was performed on an Illumina NextSeq machine using 2×150 bp paired-end reads. Library preparation and sequencing was repeated four more times using alternative kits, KAPA Hyper Prep kit (KAPA Biosystems; for library preparation) and HiSeq 2500 (for sequencing). As the replicates showed consistent results, we aggregated the data from all five runs and used it for the analysis in this report. For quality control of sequencing reads, Cutadapt (version 1.11) and Trimmomatic (version 0.36) was used to trim adapter sequences and low quality bases at the ends—reads that were trimmed to be shorter than 30 nts were removed. Reads that contain a region of consecutive low quality bases in the middle were also removed. For alignment, HISAT2 (version 2.1.0) was used to map reads on human genome (hg19) in the paired-end, two-pass mode, generating alignments in SAM format. Using Samtools, the SAM files were converted to BAM format and subsequently sorted and indexed by chromosomal coordinate. Gene annotation was not provided to the alignment program in order to avoid any biased alignment favoring annotated splice junctions. The sorted BAM files were indexed using Samtools. IGV was used to draw Sashimi plots, which showed the number of reads supporting splice junctions in the genomic region containing CLN7/MFSD8 exon 5 through 7.

Lysosomal Function Assessment

Lysosomal and cytosolic activity of lysosomal beta-Glucocerebrosidase (GCase) was measured in living cultures of patient and control fibroblasts using the artificial GCase substrate, PFB-FD-Gluc. Activity was normalized to lysosomal mass, quantified by cascade blue dextran, and analyzed as previously described (Mazzulli et al., Proc. Natl. Acad. Sci. 113, 1931-1936, 2016). Autofluorescent pigment was measured by assaying fluorescence of living cells in a microplate reader cultured in phenol red-free media (excitation=485 nm, emission at 530 nm). Values are presented as mean+/−SEM and p-values are presented using Student's t-test. For autophagic flux assays, fibroblasts were treated with either DMSO (vehicle control), or bafilomycin A1 (Baf A1) to autophagic lysosomal fusion. Cells were extracted in 1% Triton X-100 buffer and response to bafA1 was analyzed by western blot analysis for LC3 levels. alpha-Tubulin (a-Tub) or GAPDH were used as loading controls.

Other Embodiments

From the foregoing description, it will be apparent that variations and modifications may be made to the invention described herein to adopt it to various usages and conditions. Such embodiments are also within the scope of the following claims.

The recitation of a listing of elements in any definition of a variable herein includes definitions of that variable as any single element or combination (or subcombination) of listed elements. The recitation of an embodiment herein includes that embodiment as any single embodiment or in combination with any other embodiments or portions thereof.

All patents and publications mentioned in this specification are herein incorporated by reference to the same extent as if each independent patent and publication was specifically and individually indicated to be incorporated by reference.

SEQUENCE LISTING (2611 sequences)

SEQ ID NO: 1 - DNA, 1387 bp, Homo sapiens
ctctccctctccctctccctctccctctccctctccctctccctctcccctctttctacggtctccctctgttgccgaggctggactgtactgccgtgatctcggctcgctgcaacctccctgcctcgggctccagtgattctcctgcctcggcctgccgagtgcctgggattgcaggcacgcgccgccacgcctgactggtttttgtatttttggtggagacggggtttcgctgtgttgaccgggctggtctccagctcctggcctcgagtgatctgcccgcctcggcctcccgaggtgctgggattgcagacggagtctcgctcactcagtgctcaatgttgcccaggctggagtgcagtggcgtgatctcggctcgctacaacctccacctcccagccgcctgccttggcctcccaaagtgctaagattgcagcctctgcccggccgccaccccgtctgggaagtgaggagcgtctctgcctggccgcccatcgtctgggatgtgaggagcccctctgcccggccgccccgtctgggaagtgaggagcgcctctgcccggccgccaccccgtctgggaagtgaggagcgtctctgcccggccgcccatcgtctgggatgtgaggagcgcctctgcccggccgccccgtctgggatgtgaggagcgcctctgcccggccagccgccccgtctgggaggtgggggggtcagccccccgcccggccagccgccccgtctgggaggaggtgggggggtcagccccccgcccggccagccgccccgtctgggaggtgaggggcgcctctgcccggccgccccttctgggaagtgaggagcccctctgcccggccaccgccccgtctgggaggtgtacccagcgaccattgagaacgggccatgatgacgatggcggttttgtcgaaaagaaaagggggaaatgtggggaaaagaaagagagatcagattgttactgtgtctgtgtagaaagaagtagacataggagactccattttgttctgtactaagaaaaattcttctgccttgggatgctgttaatctataaccttacccccaaccccgtgctctctgaaacatgtgctgtgtcaactcagggttaaatggattaagggcggtgcaagatgtgctttgttaaacagatgcttgaaggcagcatgctcgttaagagtcatcaccactccctaatctcaagtacccagggacacaaacactgcggaaggccgcagggacctctgcctaggaaaaccagagacctttgttcacgtgtttatctgctgaccttctctccactattatcctatgaccctgccacatccccctctccgagaaacacccaagaatgatcaataaatactaaaaaaaaaaaaa

SEQ ID NO: 2 - DNA, 1383 bp, Homo sapiens
ctctccctctccctctccctctccctctccctctccctctccctgtcccctctttccacggtctccctctgatgccgagccgaggctggactgtactgccgccatctcggctcactgcaacctccctgcctgattctcctgcctcagcctgccgagtgcctgggattgcaggcgcgcgccgccacgcctgactggtttttgtattttttggtggagacggggtttcgccgtgttggccgggctggtctccagctcctgaccgcgagtgatctgcccgcctcggcctcccgaggtgccgggattgcagacggagtctcgctcactcagtgctcaatgttgcccaggctggagtgcagtggcgtgatctcggctcgctacaacctccacctcccagccgcctgccttggcctcccaaagtgccgagattgcagcctctgcccggccgccaccccgtctgggaagtgaggagcgtctctgcctggccgcccatcgtctgggatgtgaggagcccctctgcccggccgcccagtctgggaagtgaggagcgcctcttcccggccgccatcccgtctgggaagtgaggagcgtctctgcccggccgcccatcgtctgggatgtggggagcgcctctgccccgccgccccgtctgggatgtgaggagcgcctctgcccggccagccgccccgtctgggaggtgggggggtcagccccccgcccggccagccgccccgtccgggaggaggtgggggggtcagccccccgcccggccagccgccccgtctgggaggtggggggcgcctctgcccggccgccccgtctgggaagtgaggagcccctctgcccggccgccaccccgtctgggaggtgtacccaacagctcattgagaacgggccatgatgacgatggcggttttgtcgaatagaaaagggggaaatgtggggaaaagaaagagagatcagattgttactgtgtctgtgtagaaagaagtagacataggagactccattttgttctgtactaagaaaaattcttctgccttgggatgctgttaatctataaccttacccccaaccccgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacatgtttatctgctgaccttccctccactattgtcctatgaccctgccaaatccccctctccgagaaacacccaagaatgatcaataaatactaaaaaaaaaaaaa

SEQ ID NO: 3 - DNA, 1384 bp, Homo sapiens
ctctccctctccctctccctctccctctccctctccctctccctctcccctctttccacggtctccctctgatgccgagccgaagctggactgtactgctgccatctcggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccgcgagtgatccgccagcctcggcctcccgaggtgccgggattgcagacggagtctcgttcactcagtgctcaatgttgcccaggctggagtgcagtggcgtgatctcggctcgctacaacctccacctcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctgggaagtgaggagcgcctcttcccggccgccatcccgtctaggaagtgaggagcgtctctgcccggccgcccatcgtctgagatgtggggagcgcctctgccccgccgccccgtctgggatgtgaggagcgcctctgcccggccagccgccccgtctgggaggtgggggggtcagccccccgcccggccagccgccccgtccgggaggaggtgggggggtcagccccccgcccggccagccgccccgtccgggaggtggggggcgcctctgcccggccgccccttctgggaagtgaggagcccctctgcccggccaccaccccgtctgggaggtgtacccaacagctcattgagaacgggccatgatgacgatggcggttttgtggaatagaaaggggggaaaggtggggaaaagatagagaaatcggattgttgctgtgtctgtgtagaaagaagtagacatgggagacttcattttgttctgtactaagaaaaattcttctgccttgggatgctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgcgagaaacacccaagaatgatcaataaaaaaaaaaaaaaaaaaaa

SEQ ID NO: 4 - DNA, 1386 bp, Homo sapiens
ctctccctctccctctccctctccctctccctctccctctccctctcccctctttccacggtctccctctgatgccgagccgaagctggactgtactgctgccatctcggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccgcgagtgatccgccagcctcggcctcccgaggtgccgggattgcagacggagtctggttcactcagtgctcaatggtgcccaggctggagtgcagtggcgtgatctcggctcgctacaacctccacctcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctgggaagtgaggagcgtctctgcccggccgccatcccatctaggaagtgaggagcgtctctgcccggccgcccatcgtctgagatgtggggagcgcctctgccccgccgccccgtctgggatgtgaggagcgcctctgcccggccagccgccccgtctgggaggtgggggggtcagccccccgcccggccagccgccccgtccgggaggaggtgggggggtcagccccccgcccggccagccgccccgtccgggaggtgaggggcgcctctgcccggccgcccctactgggaagtgaggagcccctctgcccggccaccaccccgtctgggaggtgtacccaacagctcattgagaacgggccatgatgacaatggcggttttgtggaatagaaaggggggaaaggtggggaaaagattgagaaatcggatggttgccgtgtctgtgtagaaagaggtagacatgggagacttttcattttgttctgtactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgcgagaaacacccaagaatgatcaataaaaaaaaaaaaaaaaaaaa

SEQ ID NO: 5 - DNA, 1382 bp, Homo sapiens
ctctccctctccctctccctctccctctccctctccctctccctctcccctctctccacggtctccctctgatgccgagccaaagctggacggtactgctgccatctcggctcactgcaacctccctgcctgattctcctgcctcagcctgccgagtgcctgcgattgcaggcgcgcgccgccacgcctgactggttttcgtttttttttggtggagacggggtttcgctgtgttggccgggctggtctccagctcctaaccgcgagtgatccgccagcctcggcctcccgaggtgccgggattgcagacggagtctcgttcactcagtgctcaatggtgcccaggctggagtgcagtggcgtgatctcggctcgctacaaccacctcccagccgcctgccttggcctcccaaagagccggattgcagcctctgcccggccgccaccccgtctgggaagtgaggagcgtctctgcctggccgcccatcgtctgggatgtgaggagcccctctgcctggccgcccagtctgggaagtgaggagcgcctctgcccggccgccatcccgtctgggaagtgaggagcgtctctgcccggccgcccatcgtctgggatgtggggagcacctctgccccgccgccccgtctgggatgtgaggagcgcctctgcccggccagccgccccgtccgggaggtgggggggtcagccccccgcccggccagccgccccgtccgggaggaggtgggggggtcagccccccgcccggccagccgccccgtccgggaggtgaggggcgcctctgcccggccgcccctactgggaagtgaggagcccctctgcccggccaccgccccgtctgggaggtgtgcccagcggctcattggggatgggccatgatgacaatggcggttttgtggaatagaaaggcgggaagggtggggaaaaaattgagaaatcggatggttgccgggtctgtgtggatagaagtagacatgggagacttttcattttgttctgtactaagaaaaattcttctgccttgggatcctgttgatctgtgaccttatccccaaccctgtgctctctgaaacatgtgctgtgtccactcagggttaaatggattaagggcggtgcaagatgtgctttgttaaacagatgcttgaaggcagcatgctcgttaagagtcatcaccactccctaatcttaagtacccagggacacaaacactgcggaaggccgcagggtcctctgcctaggaaaaccagagacctttgttcacttgtttatctgctgaccttccctccactattgtcctatgaccctgccaaatccccctctgcgagaaacacccaagaatgatcaataaaaaaaaaaaaaaaaaaaa

SEQ ID NO: 6 - DNA, 1375 bp, Homo sapiens
ctctccctctccctctccctctccctctccctctccctctccctctcccctctttccacggtctccctctcatgcggagccgaagctggactgtactgctgccatctcggctcactgcaacctccctgcctgattctcctgcctcagcctgccgagtgcctgcgattgcaggcacgcgccgccacgcctgactggttttggtggagacggggtttcgctgtgttggccgggccggtctccagcccctaaccgcgagtgatccgccagcctcggcctcccgaggtgccgggattgcagacggagtctcgttcactcagtgctcaatggtgcccaggctggagtgcagtggcgtgatctcggctcgctacaacctacacctcccagccgcctgccttggcctcccaaagtgccgagattgcagcctctgcccggccgccaccccgtctgggaagtgaggagcgtctctgcctggccgcccatcgtctgggatgtgaggagcccctctgcccggccgcccagtctgggaagtgaggagcgcctccgcccggccgccatcccgtctgggaagtgaggagcgtctctgcccggccgcccatcgtctgagatgtggggagcgcctctgccccgccgccccgtctgggatgtgaggagcgcctctgcccggccagccgccccgtctgggaggtgggggggtcagccccccgcccggccagccgccccgtccgggaggaggtgggggggtcagccccccgcccggccagccgccccgtccgggaggtgaggggcgcctctgcccggccgcccctactgggaagtgaggagcccctctgcccggccaccaccccgtctgggaggtgtgcccaacagctcattgagaacgggccaggatgacaatggcggctttgtggaatagaaaggcgggaaaggtggggaaaagattgagaaatcggatggttgccgtgtctgtgtagaaagaagtagacatgggagacttttcattttgttctgtactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaaattaaaaaaaaaa

SEQ ID NO: 7 - DNA, 15 bp, Artificial Sequence
  Description of Artificial Sequence: Synthetic oligonucleotide
gggaggtggggggcg

SEQ ID NO: 8 - DNA, 15 bp, Artificial Sequence
  Description of Artificial Sequence: Synthetic oligonucleotide
ctgaccttccctcca

SEQ ID NO: 9 - DNA, 15 bp, Artificial Sequence
  Description of Artificial Sequence: Synthetic oligonucleotide
gtcctctgcctagga

SEQ ID NO: 10 - DNA, 15 bp, Artificial Sequence
  Description of Artificial Sequence: Synthetic oligonucleotide
ggaagtgaggagccc

SEQ ID NO: 11 - DNA, 15 bp, Artificial Sequence
  Description of Artificial Sequence: Synthetic oligonucleotide
tactaaaaaaaaaaa

SEQ ID NO: 12 - DNA, 15 bp, Artificial Sequence
  Description of Artificial Sequence: Synthetic oligonucleotide
gggatgctgttaatc

SEQ ID NO: 13 - DNA, 15 bp, Artificial Sequence
  Description of Artificial Sequence: Synthetic oligonucleotide
cacgcgccgccacgc

SEQ ID NO: 14 - DNA, 15 bp, Artificial Sequence
  Description of Artificial Sequence: Synthetic oligonucleotide
tctccagctcctgac

SEQ ID NO: 15 - DNA, 15 bp, Artificial Sequence
  Description of Artificial Sequence: Synthetic oligonucleotide
cgtccgggaggtggg

SEQ ID NO: 16 - DNA, 15 bp, Artificial Sequence
  Description of Artificial Sequence: Synthetic oligonucleotide
ctgtgttggccgggc

SEQ ID NO: 17 - DNA, 15 bp, Artificial Sequence
  Description of Artificial Sequence: Synthetic oligonucleotide
tctctgcctggccgc

SEQ ID NO: 18 - DNA, 15 bp, Artificial Sequence
  Description of Artificial Sequence: Synthetic oligonucleotide
gattgcaggcgcgcg

SEQ ID NO: 19 - DNA, 15 bp, Artificial Sequence
  Description of Artificial Sequence: Synthetic oligonucleotide
tggggaaaagataga

SEQ ID NO: 20 - DNA, 15 bp, Artificial Sequence
  Description of Artificial Sequence: Synthetic oligonucleotide
tgcccaggctggagt

SEQ ID NO: 21 - DNA, 15 bp, Artificial Sequence
  Description of Artificial Sequence: Synthetic oligonucleotide
atgacaatggcggtt

SEQ ID NO: 22 - DNA, 15 bp, Artificial Sequence
  Description of Artificial Sequence: Synthetic oligonucleotide
ggttttcgttttttt

SEQ ID NO: 23 - DNA, 15 bp, Artificial Sequence
  Description of Artificial Sequence: Synthetic oligonucleotide
ggcgcctctgcccgg

SEQ ID NO: 24 - DNA, 15 bp, Artificial Sequence
  Description of Artificial Sequence: Synthetic oligonucleotide
aacgggccaggatga

SEQ ID NO: 25 - DNA, 15 bp, Artificial Sequence
  Description of Artificial Sequence: Synthetic oligonucleotide
gcgcctctgcccggc

SEQ ID NO: 26 - DNA, 15 bp, Artificial Sequence
  Description of Artificial Sequence: Synthetic oligonucleotide
tccgggaggtgaggg

SEQ ID NO: 27 - DNA, 15 bp, Artificial Sequence
  Description of Artificial Sequence: Synthetic oligonucleotide
ctaaaaaaaaaaaaa

SEQ ID NO: 28 - DNA, 15 bp, Artificial Sequence
  Description of Artificial Sequence: Synthetic oligonucleotide
ccgtgttggccgggc

SEQ ID NO: 29 - DNA, 15 bp, Artificial Sequence
  Description of Artificial Sequence: Synthetic oligonucleotide
aataaaaaaaattaa

SEQ ID NO: 30 - DNA, 15 bp, Artificial Sequence
  Description of Artificial Sequence: Synthetic oligonucleotide
gccagcctcggcctc

SEQ ID NO: 31 - DNA, 15 bp, Artificial Sequence
  Description of Artificial Sequence: Synthetic oligonucleotide
ggccaccaccccgtc

SEQ ID NO: 32 - DNA, 15 bp, Artificial Sequence
  Description of Artificial Sequence: Synthetic oligonucleotide
atgatgacaatggcg

SEQ ID NO: 33 - DNA, 15 bp, Artificial Sequence
  Description of Artificial Sequence: Synthetic oligonucleotide
ctaatcttaagtacc

SEQ ID NO: 34 - DNA, 15 bp, Artificial Sequence
  Description of Artificial Sequence: Synthetic oligonucleotide
atgccgagccgaggc

SEQ ID NO: 35 - DNA, 15 bp, Artificial Sequence
  Description of Artificial Sequence: Synthetic oligonucleotide
ctcgctacaacctcc

SEQ ID NO: 36 - DNA, 15 bp, Artificial Sequence
  Description of Artificial Sequence: Synthetic oligonucleotide
tgatgccgagccaaa

SEQ ID NO: 37 - DNA, 15 bp, Artificial Sequence
  Description of Artificial Sequence: Synthetic oligonucleotide
cacgcctgactggtt

SEQ ID NO: 38 - DNA, 15 bp, Artificial Sequence
  Description of Artificial Sequence: Synthetic oligonucleotide
ggaaaagattgagaa

SEQ ID NO: 39 - DNA, 15 bp, Artificial Sequence
  Description of Artificial Sequence: Synthetic oligonucleotide
ctgccttggcctccc

SEQ ID NO: 40 - DNA, 15 bp, Artificial Sequence
  Description of Artificial Sequence: Synthetic oligonucleotide
gctgaccttctctcc

SEQ ID NO: 41 - DNA, 15 bp, Artificial Sequence
  Description of Artificial Sequence: Synthetic oligonucleotide
gcccaggctggagtg

SEQ ID NO: 42 - DNA, 15 bp, Artificial Sequence
  Description of Artificial Sequence: Synthetic oligonucleotide
gtttcgctgtgttga

SEQ ID NO: 43 - DNA, 15 bp, Artificial Sequence
  Description of Artificial Sequence: Synthetic oligonucleotide
ctccattttgttctg

SEQ ID NO: 44 - DNA, 15 bp, Artificial Sequence
  Description of Artificial Sequence: Synthetic oligonucleotide
gtttcgctgtgttgg

SEQ ID NO: 45 - DNA, 15 bp, Artificial Sequence
  Description of Artificial Sequence: Synthetic oligonucleotide
ctctccactattatc

SEQ ID NO: 46 - DNA, 15 bp, Artificial Sequence
  Description of Artificial Sequence: Synthetic oligonucleotide
gtctgtgtggataga

SEQ ID NO: 47 - DNA, 15 bp, Artificial Sequence
  Description of Artificial Sequence: Synthetic oligonucleotide
tttcgtatttttttg

SEQ ID NO: 48 - DNA, 15 bp, Artificial Sequence
  Description of Artificial Sequence: Synthetic oligonucleotide
ctttgttcacttgtt

SEQ ID NO: 49 - DNA, 15 bp, Artificial Sequence
  Description of Artificial Sequence: Synthetic oligonucleotide
acaacctacacctcc

SEQ ID NO: 50 - DNA, 15 bp, Artificial Sequence
  Description of Artificial Sequence: Synthetic oligonucleotide
gtgattctcctgcct

SEQ ID NO: 51 - DNA, 15 bp, Artificial Sequence
  Description of Artificial Sequence: Synthetic oligonucleotide
ggttaaatggattaa

SEQ ID NO: 52 - DNA, 15 bp, Artificial Sequence
  Description of Artificial Sequence: Synthetic oligonucleotide
ctgccaaatccccct

SEQ ID NO: 53 - DNA, 15 bp, Artificial Sequence
  Description of Artificial Sequence: Synthetic oligonucleotide
cctaaccgcgagtga

SEQ ID NO: 54 - DNA, 15 bp, Artificial Sequence
  Description of Artificial Sequence: Synthetic oligonucleotide
caactcagggttaaa

SEQ ID NO: 55 - DNA, 15 bp, Artificial Sequence
  Description of Artificial Sequence: Synthetic oligonucleotide
aaagtgccgagattg

SEQ ID NO: 56 - DNA, 15 bp, Artificial Sequence
  Description of Artificial Sequence: Synthetic oligonucleotide
agaatgatcaataaa

SEQ ID NO: 57 - DNA, 15 bp, Artificial Sequence
  Description of Artificial Sequence: Synthetic oligonucleotide
tgaccttatccccaa

SEQ ID NO: 58 - DNA, 15 bp, Artificial Sequence
  Description of Artificial Sequence: Synthetic oligonucleotide
tctgctgaccttctc

SEQ ID NO: 59 - DNA, 15 bp, Artificial Sequence
  Description of Artificial Sequence: Synthetic oligonucleotide
aaaggcgggaaaggt

SEQ ID NO: 60 - DNA, 15 bp, Artificial Sequence
  Description of Artificial Sequence: Synthetic oligonucleotide
ggtctgtgtggatag

SEQ ID NO: 61 - DNA, 15 bp, Artificial Sequence
  Description of Artificial Sequence: Synthetic oligonucleotide
acggtctccctctca

SEQ ID NO: 62 - DNA, 15 bp, Artificial Sequence
  Description of Artificial Sequence: Synthetic oligonucleotide
gtgatctcggctcgc

SEQ ID NO: 63 - DNA, 15 bp, Artificial Sequence
  Description of Artificial Sequence: Synthetic oligonucleotide
gtagaaagaggtaga

SEQ ID NO: 64 - DNA, 15 bp, Artificial Sequence
  Description of Artificial Sequence: Synthetic oligonucleotide
tctgcctggctgccc

SEQ ID NO: 65 - DNA, 15 bp, Artificial Sequence
  Description of Artificial Sequence: Synthetic oligonucleotide
cgattgcaggcgcgc

SEQ ID NO: 66 - DNA, 15 bp, Artificial Sequence
  Description of Artificial Sequence: Synthetic oligonucleotide
attgagaaatcggat

SEQ ID NO: 67 - DNA, 15 bp, Artificial Sequence
  Description of Artificial Sequence: Synthetic oligonucleotide
cgcctctgccccgcc

SEQ ID NO: 68 - DNA, 15 bp, Artificial Sequence
  Description of Artificial Sequence: Synthetic oligonucleotide
acccagcgaccattg

SEQ ID NO: 69 - DNA, 15 bp, Artificial Sequence
  Description of Artificial Sequence: Synthetic oligonucleotide
agcgtctctgcccgg

SEQ ID NO: 70 - DNA, 15 bp, Artificial Sequence
  Description of Artificial Sequence: Synthetic oligonucleotide
cctaatcttaagtac

SEQ ID NO: 71 - DNA, 15 bp, Artificial Sequence
  Description of Artificial Sequence: Synthetic oligonucleotide
aaagattgagaaatc

SEQ ID NO: 72 - DNA, 15 bp, Artificial Sequence
  Description of Artificial Sequence: Synthetic oligonucleotide
cgagtgatccgccag

SEQ ID NO: 73 - DNA, 15 bp, Artificial Sequence
  Description of Artificial Sequence: Synthetic oligonucleotide
ccatctaggaagtga

SEQ ID NO: 74 - DNA, 15 bp, Artificial Sequence
  Description of Artificial Sequence: Synthetic oligonucleotide
gaaagaggtagacat

SEQ ID NO: 75 - DNA, 15 bp, Artificial Sequence
  Description of Artificial Sequence: Synthetic oligonucleotide
ttggccgggccggtc

SEQ ID NO: 76 - DNA, 15 bp, Artificial Sequence
  Description of Artificial Sequence: Synthetic oligonucleotide
ggagacggggtttcg

SEQ ID NO: 77 - DNA, 15 bp, Artificial Sequence
  Description of Artificial Sequence: Synthetic oligonucleotide
ccgcgagtgatccgc

SEQ ID NO: 78 - DNA, 15 bp, Artificial Sequence
  Description of Artificial Sequence: Synthetic oligonucleotide
tagaaaggggggaaa

SEQ ID NO: 79 - DNA, 15 bp, Artificial Sequence
  Description of Artificial Sequence: Synthetic oligonucleotide
gcctcttcccggccg

SEQ ID NO: 80 - DNA, 15 bp, Artificial Sequence
  Description of Artificial Sequence: Synthetic oligonucleotide
aaagatagagaaatc

SEQ ID NO: 81 - DNA, 15 bp, Artificial Sequence
  Description of Artificial Sequence: Synthetic oligonucleotide
gccggtctccagccc

SEQ ID NO: 82 - DNA, 15 bp, Artificial Sequence
  Description of Artificial Sequence: Synthetic oligonucleotide
cggttttgtcgaaaa

SEQ ID NO: 83 - DNA, 15 bp, Artificial Sequence
  Description of Artificial Sequence: Synthetic oligonucleotide
ctttgttaaacagat

SEQ ID NO: 84 - DNA, 15 bp, Artificial Sequence
  Description of Artificial Sequence: Synthetic oligonucleotide
cagctcctaaccgcg

SEQ ID NO: 85 - DNA, 15 bp, Artificial Sequence
  Description of Artificial Sequence: Synthetic oligonucleotide
ttcacttgtttatct

SEQ ID NO: 86 - DNA, 15 bp, Artificial Sequence
  Description of Artificial Sequence: Synthetic oligonucleotide
ctcgctacaaccacc

SEQ ID NO: 87 - DNA, 15 bp, Artificial Sequence
  Description of Artificial Sequence: Synthetic oligonucleotide
cctcccagccgcctg

SEQ ID NO: 88 - DNA, 15 bp, Artificial Sequence
  Description of Artificial Sequence: Synthetic oligonucleotide
tccctaatctcaagt

SEQ ID NO: 89 - DNA, 15 bp, Artificial Sequence
  Description of Artificial Sequence: Synthetic oligonucleotide
ctgcctgattctcct

SEQ ID NO: 90 - DNA, 15 bp, Artificial Sequence
  Description of Artificial Sequence: Synthetic oligonucleotide
tgcctgcgattgcag

SEQ ID NO: 91 - DNA, 15 bp, Artificial Sequence
  Description of Artificial Sequence: Synthetic oligonucleotide
gctcactcagtgctc

SEQ ID NO: 92 - DNA, 15 bp, Artificial Sequence
  Description of Artificial Sequence: Synthetic oligonucleotide
tctcggctcgctaca

SEQ ID NO: 93 - DNA, 15 bp, Artificial Sequence
  Description of Artificial Sequence: Synthetic oligonucleotide
gccgccatctcggct

SEQ ID NO: 94 - DNA, 15 bp, Artificial Sequence
  Description of Artificial Sequence: Synthetic oligonucleotide
gctcctaaccgcgag

SEQ ID NO: 95 - DNA, 15 bp, Artificial Sequence
  Description of Artificial Sequence: Synthetic oligonucleotide
taggaaaaccagaga

SEQ ID NO: 96 - DNA, 15 bp, Artificial Sequence
  Description of Artificial Sequence: Synthetic oligonucleotide
ctcgctcactcagtg

SEQ ID NO: 97 - DNA, 15 bp, Artificial Sequence
  Description of Artificial Sequence: Synthetic oligonucleotide
cctctttctacggtc

SEQ ID NO: 98 - DNA, 15 bp, Artificial Sequence
  Description of Artificial Sequence: Synthetic oligonucleotide
tcgctgcaacctccc

SEQ ID NO: 99 - DNA, 15 bp, Artificial Sequence
  Description of Artificial Sequence: Synthetic oligonucleotide
agcacctctgccccg

SEQ ID NO: 100 - DNA, 15 bp, Artificial Sequence
  Description of Artificial Sequence: Synthetic oligonucleotide
aagtgaggagcgtct

SEQ ID NO: 101 - DNA, 15 bp, Artificial Sequence
  Description of Artificial Sequence: Synthetic oligonucleotide
agggggaaatgtggg

SEQ ID NO: 102 - DNA, 15 bp, Artificial Sequence
  Description of Artificial Sequence: Synthetic oligonucleotide
gccttgggatcctgt

SEQ ID NO: 103 - DNA, 15 bp, Artificial Sequence
  Description of Artificial Sequence: Synthetic oligonucleotide
catctaggaagtgag

SEQ ID NO: 104 - DNA, 15 bp, Artificial Sequence
  Description of Artificial Sequence: Synthetic oligonucleotide
atctgtgaccttatc

SEQ ID NO: 105 - DNA, 15 bp, Artificial Sequence
  Description of Artificial Sequence: Synthetic oligonucleotide
gggggggtcagcccc

SEQ ID NO: 106 - DNA, 15 bp, Artificial Sequence
  Description of Artificial Sequence: Synthetic oligonucleotide
gtgtttatctgctga

SEQ ID NO: 107 - DNA, 15 bp, Artificial Sequence
  Description of Artificial Sequence: Synthetic oligonucleotide
ggaaaaccagagacc

SEQ ID NO: 108 - DNA, 15 bp, Artificial Sequence
  Description of Artificial Sequence: Synthetic oligonucleotide
gcatgctcgttaaga

SEQ ID NO: 109 - DNA, 15 bp, Artificial Sequence
  Description of Artificial Sequence: Synthetic oligonucleotide
aaaagattgagaaat

SEQ ID NO: 110 - DNA, 15 bp, Artificial Sequence
  Description of Artificial Sequence: Synthetic oligonucleotide
aagtgaggagcgcct

SEQ ID NO: 111 - DNA, 15 bp, Artificial Sequence
  Description of Artificial Sequence: Synthetic oligonucleotide
accttctctccacta

SEQ ID NO: 112 - DNA, 15 bp, Artificial Sequence
  Description of Artificial Sequence: Synthetic oligonucleotide
agacttttcattttg

SEQ ID NO: 113 - DNA, 15 bp, Artificial Sequence
  Description of Artificial Sequence: Synthetic oligonucleotide
ctcggctcgctacaa

SEQ ID NO: 114 - DNA, 15 bp, Artificial Sequence
  Description of Artificial Sequence: Synthetic oligonucleotide
ctccagcccctaacc

SEQ ID NO: 115 - DNA, 15 bp, Artificial Sequence
  Description of Artificial Sequence: Synthetic oligonucleotide
aggtagacatgggag

SEQ ID NO: 116 - DNA, 15 bp, Artificial Sequence
  Description of Artificial Sequence: Synthetic oligonucleotide
tcccgaggtgctggg

SEQ ID NO: 117 - DNA, 15 bp, Artificial Sequence
  Description of Artificial Sequence: Synthetic oligonucleotide
cctcgagtgatctgc

SEQ ID NO: 118 - DNA, 15 bp, Artificial Sequence
  Description of Artificial Sequence: Synthetic oligonucleotide
ggttcactcagtgct

SEQ ID NO: 119 - DNA, 15 bp, Artificial Sequence
  Description of Artificial Sequence: Synthetic oligonucleotide
cagcctcggcctccc

SEQ ID NO: 120 - DNA, 15 bp, Artificial Sequence
  Description of Artificial Sequence: Synthetic oligonucleotide
aaggccgcagggtcc

SEQ ID NO: 121 - DNA, 15 bp, Artificial Sequence
  Description of Artificial Sequence: Synthetic oligonucleotide
gtactaagaaaaatt

SEQ ID NO: 122 - DNA, 15 bp, Artificial Sequence
  Description of Artificial Sequence: Synthetic oligonucleotide
aagatgtgctttgtt

SEQ ID NO: 123 - DNA, 15 bp, Artificial Sequence
  Description of Artificial Sequence: Synthetic oligonucleotide
aatccccctctgcga

SEQ ID NO: 124 - DNA, 15 bp, Artificial Sequence
  Description of Artificial Sequence: Synthetic oligonucleotide
tgaccctgccacatc

SEQ ID NO: 125 - DNA, 15 bp, Artificial Sequence
  Description of Artificial Sequence: Synthetic oligonucleotide
gcctctgccccgccg

SEQ ID NO: 126 - DNA, 15 bp, Artificial Sequence
  Description of Artificial Sequence: Synthetic oligonucleotide
tgggatgtgaggagc

SEQ ID NO: 127 - DNA, 15 bp, Artificial Sequence
  Description of Artificial Sequence: Synthetic oligonucleotide
ttccacggtctccct

SEQ ID NO: 128 - DNA, 15 bp, Artificial Sequence
  Description of Artificial Sequence: Synthetic oligonucleotide
ctgcctaggaaaacc

SEQ ID NO: 129 - DNA, 15 bp, Artificial Sequence
  Description of Artificial Sequence: Synthetic oligonucleotide
ggccggtctccagcc

SEQ ID NO: 130 - DNA, 15 bp, Artificial Sequence
  Description of Artificial Sequence: Synthetic oligonucleotide
ccttatccccaaccc

SEQ ID NO: 131 - DNA, 15 bp, Artificial Sequence
  Description of Artificial Sequence: Synthetic oligonucleotide
cggctcactgcaacc

SEQ ID NO: 132 - DNA, 15 bp, Artificial Sequence
  Description of Artificial Sequence: Synthetic oligonucleotide
tctgcctggccgccc

SEQ ID NO: 133 - DNA, 15 bp, Artificial Sequence
  Description of Artificial Sequence: Synthetic oligonucleotide
tcgtttttttttggt

SEQ ID NO: 134 - DNA, 15 bp, Artificial Sequence
  Description of Artificial Sequence: Synthetic oligonucleotide
caatggcggttttgt

SEQ ID NO: 135 - DNA, 15 bp, Artificial Sequence
  Description of Artificial Sequence: Synthetic oligonucleotide
cgagaaacacccaag

SEQ ID NO: 136 - DNA, 15 bp, Artificial Sequence
  Description of Artificial Sequence: Synthetic oligonucleotide
gtgttgaccgggctg

SEQ ID NO: 137 - DNA, 15 bp, Artificial Sequence
  Description of Artificial Sequence: Synthetic oligonucleotide
agacggagtctcgct

SEQ ID NO: 138 - DNA, 15 bp, Artificial Sequence
  Description of Artificial Sequence: Synthetic oligonucleotide
ccctgccaaatcccc

SEQ ID NO: 139 - DNA, 15 bp, Artificial Sequence
  Description of Artificial Sequence: Synthetic oligonucleotide
ctcctgaccgcgagt

SEQ ID NO: 140 - DNA, 15 bp, Artificial Sequence
  Description of Artificial Sequence: Synthetic oligonucleotide
aggggggaaaggtgg

SEQ ID NO: 141 - DNA, 15 bp, Artificial Sequence
  Description of Artificial Sequence: Synthetic oligonucleotide
cccggccgcccctac

SEQ ID NO: 142 - DNA, 15 bp, Artificial Sequence
  Description of Artificial Sequence: Synthetic oligonucleotide
tcagtgctcaatgtt

SEQ ID NO: 143 - DNA, 15 bp, Artificial Sequence
  Description of Artificial Sequence: Synthetic oligonucleotide
gccgaggctggactg

SEQ ID NO: 144 - DNA, 15 bp, Artificial Sequence
  Description of Artificial Sequence: Synthetic oligonucleotide
tggcctcccaaagtg

SEQ ID NO: 145 - DNA, 15 bp, Artificial Sequence
  Description of Artificial Sequence: Synthetic oligonucleotide
ctcgagtgatctgcc

SEQ ID NO: 146 - DNA, 15 bp, Artificial Sequence
  Description of Artificial Sequence: Synthetic oligonucleotide
tcgttcactcagtgc

SEQ ID NO: 147 - DNA, 15 bp, Artificial Sequence
  Description of Artificial Sequence: Synthetic oligonucleotide
ctcccctctctccac

SEQ ID NO: 148 - DNA, 15 bp, Artificial Sequence
  Description of Artificial Sequence: Synthetic oligonucleotide
ccagcgaccattgag

SEQ ID NO: 149 - DNA, 15 bp, Artificial Sequence
  Description of Artificial Sequence: Synthetic oligonucleotide
ccaggatgacaatgg

SEQ ID NO: 150 - DNA, 15 bp, Artificial Sequence
  Description of Artificial Sequence: Synthetic oligonucleotide
ctgctgccatctcgg

SEQ ID NO: 151 - DNA, 15 bp, Artificial Sequence
  Description of Artificial Sequence: Synthetic oligonucleotide
tcccatctaggaagt

SEQ ID NO: 152 - DNA, 15 bp, Artificial Sequence
  Description of Artificial Sequence: Synthetic oligonucleotide
ccatgatgacgatgg

SEQ ID NO: 153 - DNA, 15 bp, Artificial Sequence
  Description of Artificial Sequence: Synthetic oligonucleotide
gcagggacctctgcc

SEQ ID NO: 154 - DNA, 15 bp, Artificial Sequence
  Description of Artificial Sequence: Synthetic oligonucleotide
cccggccgccccgtc

SEQ ID NO: 155 - DNA, 15 bp, Artificial Sequence
  Description of Artificial Sequence: Synthetic oligonucleotide
atcttaagtacccag

SEQ ID NO: 156 - DNA, 15 bp, Artificial Sequence
  Description of Artificial Sequence: Synthetic oligonucleotide
cagcgaccattgaga

SEQ ID NO: 157 - DNA, 15 bp, Artificial Sequence
  Description of Artificial Sequence: Synthetic oligonucleotide
ccgagtgcctgggat

SEQ ID NO: 158 - DNA, 15 bp, Artificial Sequence
  Description of Artificial Sequence: Synthetic oligonucleotide
aaaagaaagagagat

SEQ ID NO: 159 - DNA, 15 bp, Artificial Sequence
  Description of Artificial Sequence: Synthetic oligonucleotide
aggcgggaaaggtgg

SEQ ID NO: 160 - DNA, 15 bp, Artificial Sequence
  Description of Artificial Sequence: Synthetic oligonucleotide
ctgttgccgaggctg

SEQ ID NO: 161 - DNA, 15 bp, Artificial Sequence
  Description of Artificial Sequence: Synthetic oligonucleotide
tgggaggaggtgggg

SEQ ID NO: 162 - DNA, 15 bp, Artificial Sequence
  Description of Artificial Sequence: Synthetic oligonucleotide
gtctccctctcatgc

SEQ ID NO: 163 - DNA, 15 bp, Artificial Sequence
  Description of Artificial Sequence: Synthetic oligonucleotide
cctaatctcaagtac

SEQ ID NO: 164 - DNA, 15 bp, Artificial Sequence
  Description of Artificial Sequence: Synthetic oligonucleotide
ccagtctgggaagtg

SEQ ID NO: 165 - DNA, 15 bp, Artificial Sequence
  Description of Artificial Sequence: Synthetic oligonucleotide
cctaatctcaagtaa

SEQ ID NO: 166 - DNA, 15 bp, Artificial Sequence
  Description of Artificial Sequence: Synthetic oligonucleotide
tccgggaggaggtgg

SEQ ID NO: 167 - DNA, 15 bp, Artificial Sequence
  Description of Artificial Sequence: Synthetic oligonucleotide
cgggtctgtgtggat

SEQ ID NO: 168 - DNA, 15 bp, Artificial Sequence
  Description of Artificial Sequence: Synthetic oligonucleotide
caacctccacctccc

SEQ ID NO: 169 - DNA, 15 bp, Artificial Sequence
  Description of Artificial Sequence: Synthetic oligonucleotide
ggctttgtggaatag

SEQ ID NO: 170 - DNA, 15 bp, Artificial Sequence
  Description of Artificial Sequence: Synthetic oligonucleotide
ctgggatgtggggag

SEQ ID NO: 171 - DNA, 15 bp, Artificial Sequence
  Description of Artificial Sequence: Synthetic oligonucleotide
ctggtctccagctcc

SEQ ID NO: 172 - DNA, 15 bp, Artificial Sequence
  Description of Artificial Sequence: Synthetic oligonucleotide
tgggaagtgaggagc

SEQ ID NO: 173 - DNA, 15 bp, Artificial Sequence
  Description of Artificial Sequence: Synthetic oligonucleotide
ccctctgttgccgag

SEQ ID NO: 174 - DNA, 15 bp, Artificial Sequence
  Description of Artificial Sequence: Synthetic oligonucleotide
gtgaccttaccccca

SEQ ID NO: 175 - DNA, 15 bp, Artificial Sequence
  Description of Artificial Sequence: Synthetic oligonucleotide
cccaaagtgccgaga

SEQ ID NO: 176 - DNA, 15 bp, Artificial Sequence
  Description of Artificial Sequence: Synthetic oligonucleotide
ggattgcagcctctg

SEQ ID NO: 177 - DNA, 15 bp, Artificial Sequence
  Description of Artificial Sequence: Synthetic oligonucleotide
gtggggaaaagattg

SEQ ID NO: 178 - DNA, 15 bp, Artificial Sequence
  Description of Artificial Sequence: Synthetic oligonucleotide
gtgcagtggcgtgat

SEQ ID NO: 179 - DNA, 15 bp, Artificial Sequence
  Description of Artificial Sequence: Synthetic oligonucleotide
taagaaaaattcttc

SEQ ID NO: 180 - DNA, 15 bp, Artificial Sequence
  Description of Artificial Sequence: Synthetic oligonucleotide
tctgggaagtgagga

SEQ ID NO: 181 - DNA, 15 bp, Artificial Sequence
  Description of Artificial Sequence: Synthetic oligonucleotide
agtgctcaatggtgc

SEQ ID NO: 182 - DNA, 15 bp, Artificial Sequence
  Description of Artificial Sequence: Synthetic oligonucleotide
gtgctttgttaaaca

SEQ ID NO: 183 - DNA, 15 bp, Artificial Sequence
  Description of Artificial Sequence: Synthetic oligonucleotide
atcccatctaggaag

SEQ ID NO: 184 - DNA, 15 bp, Artificial Sequence
  Description of Artificial Sequence: Synthetic oligonucleotide
ctgccccgccgcccc

SEQ ID NO: 185 - DNA, 15 bp, Artificial Sequence
  Description of Artificial Sequence: Synthetic oligonucleotide
gcctcggcctgccga

SEQ ID NO: 186 - DNA, 15 bp, Artificial Sequence
  Description of Artificial Sequence: Synthetic oligonucleotide
cctgccaaatccccc

SEQ ID NO: 187 - DNA, 15 bp, Artificial Sequence
  Description of Artificial Sequence: Synthetic oligonucleotide
ctccctaatctcaag

SEQ ID NO: 188 - DNA, 15 bp, Artificial Sequence
  Description of Artificial Sequence: Synthetic oligonucleotide
cccaaagtgctaaga

SEQ ID NO: 189 - DNA, 15 bp, Artificial Sequence
  Description of Artificial Sequence: Synthetic oligonucleotide
gccccgccgccccgt

SEQ ID NO: 190 - DNA, 15 bp, Artificial Sequence
  Description of Artificial Sequence: Synthetic oligonucleotide
atgggagacttcatt

SEQ ID NO: 191 - DNA, 15 bp, Artificial Sequence
  Description of Artificial Sequence: Synthetic oligonucleotide
gtgcccaggctggag

SEQ ID NO: 192 - DNA, 15 bp, Artificial Sequence
  Description of Artificial Sequence: Synthetic oligonucleotide
gccccgtctgggaag

SEQ ID NO: 193 - DNA, 15 bp, Artificial Sequence
  Description of Artificial Sequence: Synthetic oligonucleotide
agcgcctccgcccgg

SEQ ID NO: 194 - DNA, 15 bp, Artificial Sequence
  Description of Artificial Sequence: Synthetic oligonucleotide
atccgccagcctcgg

SEQ ID NO: 195 - DNA, 15 bp, Artificial Sequence
  Description of Artificial Sequence: Synthetic oligonucleotide
catgggagacttttc

SEQ ID NO: 196 - DNA, 15 bp, Artificial Sequence
  Description of Artificial Sequence: Synthetic oligonucleotide
gggtttcgccgtgtt

SEQ ID NO: 197 - DNA, 15 bp, Artificial Sequence
  Description of Artificial Sequence: Synthetic oligonucleotide
cctactgggaagtga

SEQ ID NO: 198 - DNA, 15 bp, Artificial Sequence
  Description of Artificial Sequence: Synthetic oligonucleotide
atgtggggaaaagaa

SEQ ID NO: 199 - DNA, 15 bp, Artificial Sequence
  Description of Artificial Sequence: Synthetic oligonucleotide
atgggccatgatgac

SEQ ID NO: 200 - DNA, 15 bp, Artificial Sequence
  Description of Artificial Sequence: Synthetic oligonucleotide
gccgccaccccgtct

SEQ ID NO: 201 - DNA, 15 bp, Artificial Sequence
  Description of Artificial Sequence: Synthetic oligonucleotide
ggcacgcgccgccac

SEQ ID NO: 202 - DNA, 15 bp, Artificial Sequence
  Description of Artificial Sequence: Synthetic oligonucleotide
tgtgaggagcgcctc

SEQ ID NO: 203 - DNA, 15 bp, Artificial Sequence
  Description of Artificial Sequence: Synthetic oligonucleotide
accgcgagtgatccg

SEQ ID NO: 204 - DNA, 15 bp, Artificial Sequence
  Description of Artificial Sequence: Synthetic oligonucleotide
gctgcaacctccctg

SEQ ID NO: 205 - DNA, 15 bp, Artificial Sequence
  Description of Artificial Sequence: Synthetic oligonucleotide
cccaagaattatcaa

SEQ ID NO: 206 - DNA, 15 bp, Artificial Sequence
  Description of Artificial Sequence: Synthetic oligonucleotide
gccaaatccccctct

SEQ ID NO: 207 - DNA, 15 bp, Artificial Sequence
  Description of Artificial Sequence: Synthetic oligonucleotide
ttcgctgtgttggcc

SEQ ID NO: 208 - DNA, 15 bp, Artificial Sequence
  Description of Artificial Sequence: Synthetic oligonucleotide
ctgtgaccttatccc

SEQ ID NO: 209 - DNA, 15 bp, Artificial Sequence
  Description of Artificial Sequence: Synthetic oligonucleotide
gcaacctccctgcct

SEQ ID NO: 210 - DNA, 15 bp, Artificial Sequence
  Description of Artificial Sequence: Synthetic oligonucleotide
cgaggtgctgggatt

SEQ ID NO: 211 - DNA, 15 bp, Artificial Sequence
  Description of Artificial Sequence: Synthetic oligonucleotide
cgcgagtgatccgcc

SEQ ID NO: 212 - DNA, 15 bp, Artificial Sequence
  Description of Artificial Sequence: Synthetic oligonucleotide
gaaaagaaaaggggg

SEQ ID NO: 213 - DNA, 15 bp, Artificial Sequence
  Description of Artificial Sequence: Synthetic oligonucleotide
attgttgctgtgtct

SEQ ID NO: 214 - DNA, 15 bp, Artificial Sequence
  Description of Artificial Sequence: Synthetic oligonucleotide
accgccccgtctggg

SEQ ID NO: 215 - DNA, 15 bp, Artificial Sequence
  Description of Artificial Sequence: Synthetic oligonucleotide
tgatccgccagcctc

SEQ ID NO: 216 - DNA, 15 bp, Artificial Sequence
  Description of Artificial Sequence: Synthetic oligonucleotide
tgattctcctgcctc

SEQ ID NO: 217 - DNA, 15 bp, Artificial Sequence
  Description of Artificial Sequence: Synthetic oligonucleotide
cagctcctgaccgcg

SEQ ID NO: 218 - DNA, 15 bp, Artificial Sequence
  Description of Artificial Sequence: Synthetic oligonucleotide
gtgctcaatgttgcc

SEQ ID NO: 219 - DNA, 15 bp, Artificial Sequence
  Description of Artificial Sequence: Synthetic oligonucleotide
gaggaggtggggggg

SEQ ID NO: 220 - DNA, 15 bp, Artificial Sequence
  Description of Artificial Sequence: Synthetic oligonucleotide
gctcctgaccgcgag

SEQ ID NO: 221 - DNA, 15 bp, Artificial Sequence
  Description of Artificial Sequence: Synthetic oligonucleotide
tgctcaatgttgccc

SEQ ID NO: 222 - DNA, 15 bp, Artificial Sequence
  Description of Artificial Sequence: Synthetic oligonucleotide
gtgcccagcggctca

SEQ ID NO: 223 - DNA, 15 bp, Artificial Sequence
  Description of Artificial Sequence: Synthetic oligonucleotide
cctccctgcctgatt

SEQ ID NO: 224 - DNA, 15 bp, Artificial Sequence
  Description of Artificial Sequence: Synthetic oligonucleotide
gccgagtgcctgcga

SEQ ID NO: 225 - DNA, 15 bp, Artificial Sequence
  Description of Artificial Sequence: Synthetic oligonucleotide
tctgtgaccttaccc

SEQ ID NO: 226 - DNA, 15 bp, Artificial Sequence
  Description of Artificial Sequence: Synthetic oligonucleotide
acctcccagccgcct

SEQ ID NO: 227 - DNA, 15 bp, Artificial Sequence
  Description of Artificial Sequence: Synthetic oligonucleotide
aaaattcttctgcct

SEQ ID NO: 228 - DNA, 15 bp, Artificial Sequence
  Description of Artificial Sequence: Synthetic oligonucleotide
agtctggttcactca

SEQ ID NO: 229 - DNA, 15 bp, Artificial Sequence
  Description of Artificial Sequence: Synthetic oligonucleotide
tttgtattttttggt

SEQ ID NO: 230 - DNA, 15 bp, Artificial Sequence
  Description of Artificial Sequence: Synthetic oligonucleotide
attgtcctatgaccc

SEQ ID NO: 231 - DNA, 15 bp, Artificial Sequence
  Description of Artificial Sequence: Synthetic oligonucleotide
aatctcaagtaccca

SEQ ID NO: 232 - DNA, 15 bp, Artificial Sequence
  Description of Artificial Sequence: Synthetic oligonucleotide
ttgctgtgtctgtgt

SEQ ID NO: 233 - DNA, 15 bp, Artificial Sequence
  Description of Artificial Sequence: Synthetic oligonucleotide
ccgcctgccttggcc

SEQ ID NO: 234 - DNA, 15 bp, Artificial Sequence
  Description of Artificial Sequence: Synthetic oligonucleotide
ccgaggtgccgggat

SEQ ID NO: 235 - DNA, 15 bp, Artificial Sequence
  Description of Artificial Sequence: Synthetic oligonucleotide
aagagagatcagatt

SEQ ID NO: 236 - DNA, 15 bp, Artificial Sequence
  Description of Artificial Sequence: Synthetic oligonucleotide
gcccggccaccaccc

SEQ ID NO: 237 - DNA, 15 bp, Artificial Sequence
  Description of Artificial Sequence: Synthetic oligonucleotide
gggtggggaaaaaat

SEQ ID NO: 238 - DNA, 15 bp, Artificial Sequence
  Description of Artificial Sequence: Synthetic oligonucleotide
tccacggtctccctc

SEQ ID NO: 239 - DNA, 15 bp, Artificial Sequence
  Description of Artificial Sequence: Synthetic oligonucleotide
gtctccagcccctaa

SEQ ID NO: 240 - DNA, 15 bp, Artificial Sequence
  Description of Artificial Sequence: Synthetic oligonucleotide
gcctgggattgcagg

SEQ ID NO: 241 - DNA, 15 bp, Artificial Sequence
  Description of Artificial Sequence: Synthetic oligonucleotide
cgggaggtgaggggc

SEQ ID NO: 242 - DNA, 15 bp, Artificial Sequence
  Description of Artificial Sequence: Synthetic oligonucleotide
cctcccaaagagccg

SEQ ID NO: 243 - DNA, 15 bp, Artificial Sequence
  Description of Artificial Sequence: Synthetic oligonucleotide
tggacggtactgctg

SEQ ID NO: 244 - DNA, 15 bp, Artificial Sequence
  Description of Artificial Sequence: Synthetic oligonucleotide
ccccctctgtgagaa

SEQ ID NO: 245 - DNA, 15 bp, Artificial Sequence
  Description of Artificial Sequence: Synthetic oligonucleotide
gaggtgctgggattg

SEQ ID NO: 246 - DNA, 15 bp, Artificial Sequence
  Description of Artificial Sequence: Synthetic oligonucleotide
gagtcatcaccactc

SEQ ID NO: 247 - DNA, 15 bp, Artificial Sequence
  Description of Artificial Sequence: Synthetic oligonucleotide
aaaccagagaccttt

SEQ ID NO: 248 - DNA, 15 bp, Artificial Sequence
  Description of Artificial Sequence: Synthetic oligonucleotide
cgggattgcagacgg

SEQ ID NO: 249 - DNA, 15 bp, Artificial Sequence
  Description of Artificial Sequence: Synthetic oligonucleotide
ccgaagctggactgt

SEQ ID NO: 250 - DNA, 15 bp, Artificial Sequence
  Description of Artificial Sequence: Synthetic oligonucleotide
tgactggtttttgta

SEQ ID NO: 251 - DNA, 15 bp, Artificial Sequence
  Description of Artificial Sequence: Synthetic oligonucleotide
ttttttggtggagac

SEQ ID NO: 252 - DNA, 15 bp, Artificial Sequence
  Description of Artificial Sequence: Synthetic oligonucleotide
ggatggttgccgggt

SEQ ID NO: 253 - DNA, 15 bp, Artificial Sequence
  Description of Artificial Sequence: Synthetic oligonucleotide
cggccgccatcccgt

SEQ ID NO: 254 - DNA, 15 bp, Artificial Sequence
  Description of Artificial Sequence: Synthetic oligonucleotide
ggaagtgaggagcgc

SEQ ID NO: 255 - DNA, 15 bp, Artificial Sequence
  Description of Artificial Sequence: Synthetic oligonucleotide
cgagtgcctgggatt

SEQ ID NO: 256 - DNA, 15 bp, Artificial Sequence
  Description of Artificial Sequence: Synthetic oligonucleotide
tggccgcccatcgtc

SEQ ID NO: 257 - DNA, 15 bp, Artificial Sequence
  Description of Artificial Sequence: Synthetic oligonucleotide
gagatgtggggagcg

SEQ ID NO: 258 - DNA, 15 bp, Artificial Sequence
  Description of Artificial Sequence: Synthetic oligonucleotide
cctcttcccggccgc

SEQ ID NO: 259 - DNA, 15 bp, Artificial Sequence
  Description of Artificial Sequence: Synthetic oligonucleotide
gcgtgatctcggctc

SEQ ID NO: 260 - DNA, 15 bp, Artificial Sequence
  Description of Artificial Sequence: Synthetic oligonucleotide
gtgctcaatggtgcc

SEQ ID NO: 261 - DNA, 15 bp, Artificial Sequence
  Description of Artificial Sequence: Synthetic oligonucleotide
tggaatagaaaggcg

SEQ ID NO: 262 - DNA, 15 bp, Artificial Sequence
  Description of Artificial Sequence: Synthetic oligonucleotide
aaagtgctaagattg

SEQ ID NO: 263 - DNA, 15 bp, Artificial Sequence
  Description of Artificial Sequence: Synthetic oligonucleotide
ttccctccactattg

SEQ ID NO: 264 - DNA, 15 bp, Artificial Sequence
  Description of Artificial Sequence: Synthetic oligonucleotide
ccttgggatcctgtt

SEQ ID NO: 265 - DNA, 15 bp, Artificial Sequence
  Description of Artificial Sequence: Synthetic oligonucleotide
cggggtttcgccgtg

SEQ ID NO: 266 - DNA, 15 bp, Artificial Sequence
  Description of Artificial Sequence: Synthetic oligonucleotide
ccaagaattatcaat

SEQ ID NO: 267 - DNA, 15 bp, Artificial Sequence
  Description of Artificial Sequence: Synthetic oligonucleotide
cccaacagctcattg

SEQ ID NO: 268 - DNA, 15 bp, Artificial Sequence
  Description of Artificial Sequence: Synthetic oligonucleotide
tttatctgctgacct

SEQ ID NO: 269 - DNA, 15 bp, Artificial Sequence
  Description of Artificial Sequence: Synthetic oligonucleotide
tgctgttaatctata

SEQ ID NO: 270 - DNA, 15 bp, Artificial Sequence
  Description of Artificial Sequence: Synthetic oligonucleotide
gtggggaaaaaattg

SEQ ID NO: 271 - DNA, 15 bp, Artificial Sequence
  Description of Artificial Sequence: Synthetic oligonucleotide
aggggcgcctctgcc

SEQ ID NO: 272 - DNA, 15 bp, Artificial Sequence
  Description of Artificial Sequence: Synthetic oligonucleotide
ataaaaaaaattaaa

SEQ ID NO: 273 - DNA, 15 bp, Artificial Sequence
  Description of Artificial Sequence: Synthetic oligonucleotide
cgggccaggatgaca

SEQ ID NO: 274 - DNA, 15 bp, Artificial Sequence
  Description of Artificial Sequence: Synthetic oligonucleotide
gagcccctctgcccg

SEQ ID NO: 275 - DNA, 15 bp, Artificial Sequence
  Description of Artificial Sequence: Synthetic oligonucleotide
tctcctgcctcagcc

SEQ ID NO: 276 - DNA, 15 bp, Artificial Sequence
  Description of Artificial Sequence: Synthetic oligonucleotide
gccgcagggacctct

SEQ ID NO: 277 - DNA, 15 bp, Artificial Sequence
  Description of Artificial Sequence: Synthetic oligonucleotide
gtagacatgggagac

SEQ ID NO: 278 - DNA, 15 bp, Artificial Sequence
  Description of Artificial Sequence: Synthetic oligonucleotide
ctccagctcctgacc

SEQ ID NO: 279 - DNA, 15 bp, Artificial Sequence
  Description of Artificial Sequence: Synthetic oligonucleotide
tgggatcctgttgat

SEQ ID NO: 280 - DNA, 15 bp, Artificial Sequence
  Description of Artificial Sequence: Synthetic oligonucleotide
ggatggttgccgtgt

SEQ ID NO: 281 - DNA, 15 bp, Artificial Sequence
  Description of Artificial Sequence: Synthetic oligonucleotide
ctggtttttgtattt

SEQ ID NO: 282 - DNA, 15 bp, Artificial Sequence
  Description of Artificial Sequence: Synthetic oligonucleotide
agtgaggagcgtctc

SEQ ID NO: 283 - DNA, 15 bp, Artificial Sequence
  Description of Artificial Sequence: Synthetic oligonucleotide
gtctgggaggtgggg

SEQ ID NO: 284 - DNA, 15 bp, Artificial Sequence
  Description of Artificial Sequence: Synthetic oligonucleotide
aaccccgtgctctct

SEQ ID NO: 285 - DNA, 15 bp, Artificial Sequence
  Description of Artificial Sequence: Synthetic oligonucleotide
cgtctgggaagtgag

SEQ ID NO: 286 - DNA, 15 bp, Artificial Sequence
  Description of Artificial Sequence: Synthetic oligonucleotide
tgcctcagcctgccg

SEQ ID NO: 287 - DNA, 15 bp, Artificial Sequence
  Description of Artificial Sequence: Synthetic oligonucleotide
cttatccccaaccct

SEQ ID NO: 288 - DNA, 15 bp, Artificial Sequence
  Description of Artificial Sequence: Synthetic oligonucleotide
aggagcgtctctgcc

SEQ ID NO: 289 - DNA, 15 bp, Artificial Sequence
  Description of Artificial Sequence: Synthetic oligonucleotide
tattgtcctatgacc

SEQ ID NO: 290 - DNA, 15 bp, Artificial Sequence
  Description of Artificial Sequence: Synthetic oligonucleotide
tccccaaccctgtgc

SEQ ID NO: 291 - DNA, 15 bp, Artificial Sequence
  Description of Artificial Sequence: Synthetic oligonucleotide
gactccattttgttc

SEQ ID NO: 292 - DNA, 15 bp, Artificial Sequence
  Description of Artificial Sequence: Synthetic oligonucleotide
cactattgtcctatg

SEQ ID NO: 293 - DNA, 15 bp, Artificial Sequence
  Description of Artificial Sequence: Synthetic oligonucleotide
gaagtgaggagcgcc

SEQ ID NO: 294 - DNA, 15 bp, Artificial Sequence
  Description of Artificial Sequence: Synthetic oligonucleotide
cgcagggacctctgc

SEQ ID NO: 295 - DNA, 15 bp, Artificial Sequence
  Description of Artificial Sequence: Synthetic oligonucleotide
cttgaaggcagcatg

SEQ ID NO: 296 - DNA, 15 bp, Artificial Sequence
  Description of Artificial Sequence: Synthetic oligonucleotide
ttggtggagacgggg

SEQ ID NO: 297 - DNA, 15 bp, Artificial Sequence
  Description of Artificial Sequence: Synthetic oligonucleotide
cccaaagagccggat

SEQ ID NO: 298 - DNA, 15 bp, Artificial Sequence
  Description of Artificial Sequence: Synthetic oligonucleotide
gcctgattctcctgc

SEQ ID NO: 299 - DNA, 15 bp, Artificial Sequence
  Description of Artificial Sequence: Synthetic oligonucleotide
ttttcattttgttct

SEQ ID NO: 300 - DNA, 15 bp, Artificial Sequence
  Description of Artificial Sequence: Synthetic oligonucleotide
gttactgtgtctgtg

SEQ ID NO: 301 - DNA, 15 bp, Artificial Sequence
  Description of Artificial Sequence: Synthetic oligonucleotide
tgaccgcgagtgatc

SEQ ID NO: 302 - DNA, 15 bp, Artificial Sequence
  Description of Artificial Sequence: Synthetic oligonucleotide
ctcgttcactcagtg

SEQ ID NO: 303 - DNA, 15 bp, Artificial Sequence
  Description of Artificial Sequence: Synthetic oligonucleotide
ccgccatcccgtctg

SEQ ID NO: 304 - DNA, 15 bp, Artificial Sequence
  Description of Artificial Sequence: Synthetic oligonucleotide
tctccagcccctaac

SEQ ID NO: 305 - DNA, 15 bp, Artificial Sequence
  Description of Artificial Sequence: Synthetic oligonucleotide
ctctccgagaaacac

SEQ ID NO: 306 - DNA, 15 bp, Artificial Sequence
  Description of Artificial Sequence: Synthetic oligonucleotide
ggatagaagtagaca

SEQ ID NO: 307 - DNA, 15 bp, Artificial Sequence
  Description of Artificial Sequence: Synthetic oligonucleotide
cggattgttgctgtg

SEQ ID NO: 308 - DNA, 15 bp, Artificial Sequence
  Description of Artificial Sequence: Synthetic oligonucleotide
tgtgctgtgtccact

SEQ ID NO: 309 - DNA, 15 bp, Artificial Sequence
  Description of Artificial Sequence: Synthetic oligonucleotide
aggtggggaaaagat

SEQ ID NO: 310 - DNA, 15 bp, Artificial Sequence
  Description of Artificial Sequence: Synthetic oligonucleotide
catgtgctgtgtcaa

SEQ ID NO: 311 - DNA, 15 bp, Artificial Sequence
  Description of Artificial Sequence: Synthetic oligonucleotide
tccactcagggttaa

SEQ ID NO: 312 - DNA, 15 bp, Artificial Sequence
  Description of Artificial Sequence: Synthetic oligonucleotide
gtggcgtgatctcgg

SEQ ID NO: 313 - DNA, 15 bp, Artificial Sequence
  Description of Artificial Sequence: Synthetic oligonucleotide
cccagccgcctgcct

SEQ ID NO: 314 - DNA, 15 bp, Artificial Sequence
  Description of Artificial Sequence: Synthetic oligonucleotide
tgaccgggctggtct

SEQ ID NO: 315 - DNA, 15 bp, Artificial Sequence
  Description of Artificial Sequence: Synthetic oligonucleotide
gagcccctctgcctg

SEQ ID NO: 316 - DNA, 15 bp, Artificial Sequence
  Description of Artificial Sequence: Synthetic oligonucleotide
gggccggtctccagc

SEQ ID NO: 317 - DNA, 15 bp, Artificial Sequence
  Description of Artificial Sequence: Synthetic oligonucleotide
ggctggtctccagct

SEQ ID NO: 318 - DNA, 15 bp, Artificial Sequence
  Description of Artificial Sequence: Synthetic oligonucleotide
ccctactgggaagtg

SEQ ID NO: 319 - DNA, 15 bp, Artificial Sequence
  Description of Artificial Sequence: Synthetic oligonucleotide
gaggtgtacccaaca

SEQ ID NO: 320 - DNA, 15 bp, Artificial Sequence
  Description of Artificial Sequence: Synthetic oligonucleotide
ggatgtggggagcgc

SEQ ID NO: 321 - DNA, 15 bp, Artificial Sequence
  Description of Artificial Sequence: Synthetic oligonucleotide
cctttgttcacatgt

SEQ ID NO: 322 - DNA, 15 bp, Artificial Sequence
  Description of Artificial Sequence: Synthetic oligonucleotide
atgttgcccaggctg

SEQ ID NO: 323 - DNA, 15 bp, Artificial Sequence
  Description of Artificial Sequence: Synthetic oligonucleotide
ctttgttcacatgtt

SEQ ID NO: 324 - DNA, 15 bp, Artificial Sequence
  Description of Artificial Sequence: Synthetic oligonucleotide
aaagctggacggtac

SEQ ID NO: 325 - DNA, 15 bp, Artificial Sequence
  Description of Artificial Sequence: Synthetic oligonucleotide
gatgggccatgatga

SEQ ID NO: 326 - DNA, 15 bp, Artificial Sequence
  Description of Artificial Sequence: Synthetic oligonucleotide
ctaaccgcgagtgat

SEQ ID NO: 327 - DNA, 15 bp, Artificial Sequence
  Description of Artificial Sequence: Synthetic oligonucleotide
gctttgttaaacaga

SEQ ID NO: 328 - DNA, 15 bp, Artificial Sequence
  Description of Artificial Sequence: Synthetic oligonucleotide
ccggccgccatccca

SEQ ID NO: 329 - DNA, 15 bp, Artificial Sequence
  Description of Artificial Sequence: Synthetic oligonucleotide
ccccaaccctgtgct

SEQ ID NO: 330 - DNA, 15 bp, Artificial Sequence
  Description of Artificial Sequence: Synthetic oligonucleotide
gtctccagctcctga

SEQ ID NO: 331 - DNA, 15 bp, Artificial Sequence
  Description of Artificial Sequence: Synthetic oligonucleotide
agccaaagctggacg

SEQ ID NO: 332 - DNA, 15 bp, Artificial Sequence
  Description of Artificial Sequence: Synthetic oligonucleotide
gtctccagctcctgg

SEQ ID NO: 333 - DNA, 15 bp, Artificial Sequence
  Description of Artificial Sequence: Synthetic oligonucleotide
tgcgattgcaggcgc

SEQ ID NO: 334 - DNA, 15 bp, Artificial Sequence
  Description of Artificial Sequence: Synthetic oligonucleotide
gaaaagatagagaaa

SEQ ID NO: 335 - DNA, 15 bp, Artificial Sequence
  Description of Artificial Sequence: Synthetic oligonucleotide
ggttgccgggtctgt

SEQ ID NO: 336 - DNA, 15 bp, Artificial Sequence
  Description of Artificial Sequence: Synthetic oligonucleotide
gctggtctccagctc

SEQ ID NO: 337 - DNA, 15 bp, Artificial Sequence
  Description of Artificial Sequence: Synthetic oligonucleotide
gcagcctctgcccgg

SEQ ID NO: 338 - DNA, 15 bp, Artificial Sequence
  Description of Artificial Sequence: Synthetic oligonucleotide
ttgcaggcgcgcgcc

SEQ ID NO: 339 - DNA, 15 bp, Artificial Sequence
  Description of Artificial Sequence: Synthetic oligonucleotide
ccacatccccctctc

SEQ ID NO: 340 - DNA, 15 bp, Artificial Sequence
  Description of Artificial Sequence: Synthetic oligonucleotide
gggatgtgaggagcg

SEQ ID NO: 341 - DNA, 15 bp, Artificial Sequence
  Description of Artificial Sequence: Synthetic oligonucleotide
ctccgcccggccgcc

SEQ ID NO: 342 - DNA, 15 bp, Artificial Sequence
  Description of Artificial Sequence: Synthetic oligonucleotide
gggatgtgaggagcc

SEQ ID NO: 343 - DNA, 15 bp, Artificial Sequence
  Description of Artificial Sequence: Synthetic oligonucleotide
agactccattttgtt

SEQ ID NO: 344 - DNA, 15 bp, Artificial Sequence
  Description of Artificial Sequence: Synthetic oligonucleotide
atcggattgttgctg

SEQ ID NO: 345 - DNA, 15 bp, Artificial Sequence
  Description of Artificial Sequence: Synthetic oligonucleotide
gaggtgggggggtca

SEQ ID NO: 346 - DNA, 15 bp, Artificial Sequence
  Description of Artificial Sequence: Synthetic oligonucleotide
cctctgccccgccgc

SEQ ID NO: 347 - DNA, 15 bp, Artificial Sequence
  Description of Artificial Sequence: Synthetic oligonucleotide
cctctgtgagaaaca

SEQ ID NO: 348 - DNA, 15 bp, Artificial Sequence
  Description of Artificial Sequence: Synthetic oligonucleotide
gacctttgttcacat

SEQ ID NO: 349 - DNA, 15 bp, Artificial Sequence
  Description of Artificial Sequence: Synthetic oligonucleotide
ctgccatctcggctc

SEQ ID NO: 350 - DNA, 15 bp, Artificial Sequence
  Description of Artificial Sequence: Synthetic oligonucleotide
tgctgaccttctctc

SEQ ID NO: 351 - DNA, 15 bp, Artificial Sequence
  Description of Artificial Sequence: Synthetic oligonucleotide
ctctccctgtcccct

SEQ ID NO: 352 - DNA, 15 bp, Artificial Sequence
  Description of Artificial Sequence: Synthetic oligonucleotide
gccgcccagtctggg

SEQ ID NO: 353 - DNA, 15 bp, Artificial Sequence
  Description of Artificial Sequence: Synthetic oligonucleotide
ctgcggaaggccgca

SEQ ID NO: 354 - DNA, 15 bp, Artificial Sequence
  Description of Artificial Sequence: Synthetic oligonucleotide
cccggccgcccatcg

SEQ ID NO: 355 - DNA, 15 bp, Artificial Sequence
  Description of Artificial Sequence: Synthetic oligonucleotide
aaaaattcttctgcc

SEQ ID NO: 356 - DNA, 15 bp, Artificial Sequence
  Description of Artificial Sequence: Synthetic oligonucleotide
gccgagtgcctggga

SEQ ID NO: 357 - DNA, 15 bp, Artificial Sequence
  Description of Artificial Sequence: Synthetic oligonucleotide
ctgctgaccttccct

SEQ ID NO: 358 - DNA, 15 bp, Artificial Sequence
  Description of Artificial Sequence: Synthetic oligonucleotide
acgcctgactggttt

SEQ ID NO: 359 - DNA, 15 bp, Artificial Sequence
  Description of Artificial Sequence: Synthetic oligonucleotide
acccaacagctcatt

SEQ ID NO: 360 - DNA, 15 bp, Artificial Sequence
  Description of Artificial Sequence: Synthetic oligonucleotide
ggattgttgctgtgt

SEQ ID NO: 361 - DNA, 15 bp, Artificial Sequence
  Description of Artificial Sequence: Synthetic oligonucleotide
ccctgcctgattctc

SEQ ID NO: 362 - DNA, 15 bp, Artificial Sequence
  Description of Artificial Sequence: Synthetic oligonucleotide
tgccgtgtctgtgta

SEQ ID NO: 363 - DNA, 15 bp, Artificial Sequence
  Description of Artificial Sequence: Synthetic oligonucleotide
ggaaaggtggggaaa

SEQ ID NO: 364 - DNA, 15 bp, Artificial Sequence
  Description of Artificial Sequence: Synthetic oligonucleotide
gtggggaaaagaaag

SEQ ID NO: 365 - DNA, 15 bp, Artificial Sequence
  Description of Artificial Sequence: Synthetic oligonucleotide
tgggagacttcattt

SEQ ID NO: 366 - DNA, 15 bp, Artificial Sequence
  Description of Artificial Sequence: Synthetic oligonucleotide
tctgggaggtgtgcc

SEQ ID NO: 367 - DNA, 15 bp, Artificial Sequence
  Description of Artificial Sequence: Synthetic oligonucleotide
ggacacaaacactgc

SEQ ID NO: 368 - DNA, 15 bp, Artificial Sequence
  Description of Artificial Sequence: Synthetic oligonucleotide
tgcctggccgcccag

SEQ ID NO: 369 - DNA, 15 bp, Artificial Sequence
  Description of Artificial Sequence: Synthetic oligonucleotide
acggagtctcgctca

SEQ ID NO: 370 - DNA, 15 bp, Artificial Sequence
  Description of Artificial Sequence: Synthetic oligonucleotide
gtctcgctcactcag

SEQ ID NO: 371 - DNA, 15 bp, Artificial Sequence
  Description of Artificial Sequence: Synthetic oligonucleotide
tcaagtaatcaggga

SEQ ID NO: 372 - DNA, 15 bp, Artificial Sequence
  Description of Artificial Sequence: Synthetic oligonucleotide
gcggttttgtcgaat

SEQ ID NO: 373 - DNA, 15 bp, Artificial Sequence
  Description of Artificial Sequence: Synthetic oligonucleotide
gccaaagctggacgg

SEQ ID NO: 374 - DNA, 15 bp, Artificial Sequence
  Description of Artificial Sequence: Synthetic oligonucleotide
cactccctaatctta

SEQ ID NO: 375 - DNA, 15 bp, Artificial Sequence
  Description of Artificial Sequence: Synthetic oligonucleotide
accactccctaatct

SEQ ID NO: 376 - DNA, 15 bp, Artificial Sequence
  Description of Artificial Sequence: Synthetic oligonucleotide
gcggttttgtcgaaa

SEQ ID NO: 377 - DNA, 15 bp, Artificial Sequence
  Description of Artificial Sequence: Synthetic oligonucleotide
ttgtggaatagaaag

SEQ ID NO: 378 - DNA, 15 bp, Artificial Sequence
  Description of Artificial Sequence: Synthetic oligonucleotide
cccgtgctctctgaa

SEQ ID NO: 379 - DNA, 15 bp, Artificial Sequence
  Description of Artificial Sequence: Synthetic oligonucleotide
taggaagtgaggagc

SEQ ID NO: 380 - DNA, 15 bp, Artificial Sequence
  Description of Artificial Sequence: Synthetic oligonucleotide
aaaaattgagaaatc

SEQ ID NO: 381 - DNA, 15 bp, Artificial Sequence
  Description of Artificial Sequence: Synthetic oligonucleotide
gcggagccgaagctg

SEQ ID NO: 382 - DNA, 15 bp, Artificial Sequence
  Description of Artificial Sequence: Synthetic oligonucleotide
ctctcatgcggagcc

SEQ ID NO: 383 - DNA, 15 bp, Artificial Sequence
  Description of Artificial Sequence: Synthetic oligonucleotide
ggtgaggggcgcctc

SEQ ID NO: 384 - DNA, 15 bp, Artificial Sequence
  Description of Artificial Sequence: Synthetic oligonucleotide
aggccgcagggtcct

SEQ ID NO: 385 - DNA, 15 bp, Artificial Sequence
  Description of Artificial Sequence: Synthetic oligonucleotide
gccacgcctgactgg

SEQ ID NO: 386 - DNA, 15 bp, Artificial Sequence
  Description of Artificial Sequence: Synthetic oligonucleotide
cggccgccatcccat

SEQ ID NO: 387 - DNA, 15 bp, Artificial Sequence
  Description of Artificial Sequence: Synthetic oligonucleotide
tctccagctcctggc

SEQ ID NO: 388 - DNA, 15 bp, Artificial Sequence
  Description of Artificial Sequence: Synthetic oligonucleotide
tccgagaaacaccca

SEQ ID NO: 389 - DNA, 15 bp, Artificial Sequence
  Description of Artificial Sequence: Synthetic oligonucleotide
cactcagggttaaat

SEQ ID NO: 390 - DNA, 15 bp, Artificial Sequence
  Description of Artificial Sequence: Synthetic oligonucleotide
cggccaccgccccgt

SEQ ID NO: 391 - DNA, 15 bp, Artificial Sequence
  Description of Artificial Sequence: Synthetic oligonucleotide
gtagacataggagac

SEQ ID NO: 392 - DNA, 15 bp, Artificial Sequence
  Description of Artificial Sequence: Synthetic oligonucleotide
agtgctaagattgca

SEQ ID NO: 393 - DNA, 15 bp, Artificial Sequence
  Description of Artificial Sequence: Synthetic oligonucleotide
ttctgccttgggatg

SEQ ID NO: 394 - DNA, 15 bp, Artificial Sequence
  Description of Artificial Sequence: Synthetic oligonucleotide
tcccctctttccacg

SEQ ID NO: 395 - DNA, 15 bp, Artificial Sequence
  Description of Artificial Sequence: Synthetic oligonucleotide
ggggaaaagaaagag

SEQ ID NO: 396 - DNA, 15 bp, Artificial Sequence
  Description of Artificial Sequence: Synthetic oligonucleotide
agattgttactgtgt

SEQ ID NO: 397 - DNA, 15 bp, Artificial Sequence
  Description of Artificial Sequence: Synthetic oligonucleotide
tcgctacaacctaca

SEQ ID NO: 398 - DNA, 15 bp, Artificial Sequence
  Description of Artificial Sequence: Synthetic oligonucleotide
ctcccaaagtgctaa

SEQ ID NO: 399 - DNA, 15 bp, Artificial Sequence
  Description of Artificial Sequence: Synthetic oligonucleotide
cccagcgaccattga

SEQ ID NO: 400 - DNA, 15 bp, Artificial Sequence
  Description of Artificial Sequence: Synthetic oligonucleotide
cctcggcctgccgag

SEQ ID NO: 401 - DNA, 15 bp, Artificial Sequence
  Description of Artificial Sequence: Synthetic oligonucleotide
cgagattgcagcctc

SEQ ID NO: 402 - DNA, 15 bp, Artificial Sequence
  Description of Artificial Sequence: Synthetic oligonucleotide
aatactaaaaaaaaa

SEQ ID NO: 403 - DNA, 15 bp, Artificial Sequence
  Description of Artificial Sequence: Synthetic oligonucleotide
gctcctggcctcgag

SEQ ID NO: 404 - DNA, 15 bp, Artificial Sequence
  Description of Artificial Sequence: Synthetic oligonucleotide
tcgtctgagatgtgg

SEQ ID NO: 405 - DNA, 15 bp, Artificial Sequence
  Description of Artificial Sequence: Synthetic oligonucleotide
atcaataaatactaa

SEQ ID NO: 406 - DNA, 15 bp, Artificial Sequence
  Description of Artificial Sequence: Synthetic oligonucleotide
gaagtgaggagcgtc

SEQ ID NO: 407 - DNA, 15 bp, Artificial Sequence
  Description of Artificial Sequence: Synthetic oligonucleotide
ggattgcaggcacgc

SEQ ID NO: 408 - DNA, 15 bp, Artificial Sequence
  Description of Artificial Sequence: Synthetic oligonucleotide
aaattcttctgcctt

SEQ ID NO: 409 - DNA, 15 bp, Artificial Sequence
  Description of Artificial Sequence: Synthetic oligonucleotide
cgctacaaccacctc

SEQ ID NO: 410 - DNA, 15 bp, Artificial Sequence
  Description of Artificial Sequence: Synthetic oligonucleotide
ggcgggaaaggtggg

SEQ ID NO: 411 - DNA, 15 bp, Artificial Sequence
  Description of Artificial Sequence: Synthetic oligonucleotide
tctctgcccggccgc

SEQ ID NO: 412 - DNA, 15 bp, Artificial Sequence
  Description of Artificial Sequence: Synthetic oligonucleotide
atggcggttttgtcg

SEQ ID NO: 413 - DNA, 15 bp, Artificial Sequence
  Description of Artificial Sequence: Synthetic oligonucleotide
caagaatgatcaata

SEQ ID NO: 414 - DNA, 15 bp, Artificial Sequence
  Description of Artificial Sequence: Synthetic oligonucleotide
ctgtgaccttacccc

SEQ ID NO: 415 - DNA, 15 bp, Artificial Sequence
  Description of Artificial Sequence: Synthetic oligonucleotide
tgcagcctctgcccg

SEQ ID NO: 416 - DNA, 15 bp, Artificial Sequence
  Description of Artificial Sequence: Synthetic oligonucleotide
aaccttacccccaac

SEQ ID NO: 417 - DNA, 15 bp, Artificial Sequence
  Description of Artificial Sequence: Synthetic oligonucleotide
tggaatagaaagggg

SEQ ID NO: 418 - DNA, 15 bp, Artificial Sequence
  Description of Artificial Sequence: Synthetic oligonucleotide
aagtaatcagggaca

SEQ ID NO: 419 - DNA, 15 bp, Artificial Sequence
  Description of Artificial Sequence: Synthetic oligonucleotide
aaccacctcccagcc

SEQ ID NO: 420 - DNA, 15 bp, Artificial Sequence
  Description of Artificial Sequence: Synthetic oligonucleotide
gtgtcaactcagggt

SEQ ID NO: 421 - DNA, 15 bp, Artificial Sequence
  Description of Artificial Sequence: Synthetic oligonucleotide
gtgaccttatcccca

SEQ ID NO: 422 - DNA, 15 bp, Artificial Sequence
  Description of Artificial Sequence: Synthetic oligonucleotide
gggtttcgctgtgtt

SEQ ID NO: 423 - DNA, 15 bp, Artificial Sequence
  Description of Artificial Sequence: Synthetic oligonucleotide
ctccgagaaacaccc

SEQ ID NO: 424 - DNA, 15 bp, Artificial Sequence
  Description of Artificial Sequence: Synthetic oligonucleotide
gccttgggatgctgt

SEQ ID NO: 425 - DNA, 15 bp, Artificial Sequence
  Description of Artificial Sequence: Synthetic oligonucleotide
gacaatggcggcttt

SEQ ID NO: 426 - DNA, 15 bp, Artificial Sequence
  Description of Artificial Sequence: Synthetic oligonucleotide
taaccgcgagtgatc

SEQ ID NO: 427 - DNA, 15 bp, Artificial Sequence
  Description of Artificial Sequence: Synthetic oligonucleotide
agacggggtttcgcc

SEQ ID NO: 428 - DNA, 15 bp, Artificial Sequence
  Description of Artificial Sequence: Synthetic oligonucleotide
gactgtactgctgcc

SEQ ID NO: 429 - DNA, 15 bp, Artificial Sequence
  Description of Artificial Sequence: Synthetic oligonucleotide
ggttttgtcgaatag

SEQ ID NO: 430 - DNA, 15 bp, Artificial Sequence
  Description of Artificial Sequence: Synthetic oligonucleotide
tcctctgcctaggaa

SEQ ID NO: 431 - DNA, 15 bp, Artificial Sequence
  Description of Artificial Sequence: Synthetic oligonucleotide
gtctgggaggaggtg

SEQ ID NO: 432 - DNA, 15 bp, Artificial Sequence
  Description of Artificial Sequence: Synthetic oligonucleotide
gtctgggaggtgtgc

SEQ ID NO: 433 - DNA, 15 bp, Artificial Sequence
  Description of Artificial Sequence: Synthetic oligonucleotide
ctccctctgatgccg

SEQ ID NO: 434 - DNA, 15 bp, Artificial Sequence
  Description of Artificial Sequence: Synthetic oligonucleotide
agacggggtttcgct

SEQ ID NO: 435 - DNA, 15 bp, Artificial Sequence
  Description of Artificial Sequence: Synthetic oligonucleotide
acatgtttatctgct

SEQ ID NO: 436 - DNA, 15 bp, Artificial Sequence
  Description of Artificial Sequence: Synthetic oligonucleotide
gaatagaaaaggggg

SEQ ID NO: 437 - DNA, 15 bp, Artificial Sequence
  Description of Artificial Sequence: Synthetic oligonucleotide
tgggatgctgttgat

SEQ ID NO: 438 - DNA, 15 bp, Artificial Sequence
  Description of Artificial Sequence: Synthetic oligonucleotide
tggccgggctggtct

SEQ ID NO: 439 - DNA, 15 bp, Artificial Sequence
  Description of Artificial Sequence: Synthetic oligonucleotide
tcaataaaaaaaatt

SEQ ID NO: 440 - DNA, 15 bp, Artificial Sequence
  Description of Artificial Sequence: Synthetic oligonucleotide
gaaatgtggggaaaa

SEQ ID NO: 441 - DNA, 15 bp, Artificial Sequence
  Description of Artificial Sequence: Synthetic oligonucleotide
gctacaacctccacc

SEQ ID NO: 442 - DNA, 15 bp, Artificial Sequence
  Description of Artificial Sequence: Synthetic oligonucleotide
cgcctgactggtttt

SEQ ID NO: 443 - DNA, 15 bp, Artificial Sequence
  Description of Artificial Sequence: Synthetic oligonucleotide
ctgggaagtgaggag

SEQ ID NO: 444 - DNA, 15 bp, Artificial Sequence
  Description of Artificial Sequence: Synthetic oligonucleotide
gatccgccagcctcg

SEQ ID NO: 445 - DNA, 15 bp, Artificial Sequence
  Description of Artificial Sequence: Synthetic oligonucleotide
gtacccagcgaccat

SEQ ID NO: 446 - DNA, 15 bp, Artificial Sequence
  Description of Artificial Sequence: Synthetic oligonucleotide
tcttcccggccgcca

SEQ ID NO: 447 - DNA, 15 bp, Artificial Sequence
  Description of Artificial Sequence: Synthetic oligonucleotide
gcgcgcgccgccacg

SEQ ID NO: 448 - DNA, 15 bp, Artificial Sequence
  Description of Artificial Sequence: Synthetic oligonucleotide
cggctttgtggaata

SEQ ID NO: 449 - DNA, 15 bp, Artificial Sequence
  Description of Artificial Sequence: Synthetic oligonucleotide
gtctccctctgttgc

SEQ ID NO: 450 - DNA, 15 bp, Artificial Sequence
  Description of Artificial Sequence: Synthetic oligonucleotide
ctcccctctttccac

SEQ ID NO: 451 - DNA, 15 bp, Artificial Sequence
  Description of Artificial Sequence: Synthetic oligonucleotide
tcccagccgcctgcc

SEQ ID NO: 452 - DNA, 15 bp, Artificial Sequence
  Description of Artificial Sequence: Synthetic oligonucleotide
gctctctgaaacatg

SEQ ID NO: 453 - DNA, 15 bp, Artificial Sequence
  Description of Artificial Sequence: Synthetic oligonucleotide
gggaaaagattgaga

SEQ ID NO: 454 - DNA, 15 bp, Artificial Sequence
  Description of Artificial Sequence: Synthetic oligonucleotide
cgcgcgccgccacgc

SEQ ID NO: 455 - DNA, 15 bp, Artificial Sequence
  Description of Artificial Sequence: Synthetic oligonucleotide
ccctctgatgccgag

SEQ ID NO: 456 - DNA, 15 bp, Artificial Sequence
  Description of Artificial Sequence: Synthetic oligonucleotide
ttgggatgctgttaa

SEQ ID NO: 457 - DNA, 15 bp, Artificial Sequence
  Description of Artificial Sequence: Synthetic oligonucleotide
tgcccagtctgggaa

SEQ ID NO: 458 - DNA, 15 bp, Artificial Sequence
  Description of Artificial Sequence: Synthetic oligonucleotide
cacccaagaatgatc

SEQ ID NO: 459 - DNA, 15 bp, Artificial Sequence
  Description of Artificial Sequence: Synthetic oligonucleotide
ctccagctcctaacc

SEQ ID NO: 460 - DNA, 15 bp, Artificial Sequence
  Description of Artificial Sequence: Synthetic oligonucleotide
ggcgggaagggtggg

SEQ ID NO: 461 - DNA, 15 bp, Artificial Sequence
  Description of Artificial Sequence: Synthetic oligonucleotide
ctgattctcctgcct

SEQ ID NO: 462 - DNA, 15 bp, Artificial Sequence
  Description of Artificial Sequence: Synthetic oligonucleotide
aggcgggaagggtgg

SEQ ID NO: 463 - DNA, 15 bp, Artificial Sequence
  Description of Artificial Sequence: Synthetic oligonucleotide
cccccgcccggccag

SEQ ID NO: 464 - DNA, 15 bp, Artificial Sequence
  Description of Artificial Sequence: Synthetic oligonucleotide
cctggccgcccagtc

SEQ ID NO: 465 - DNA, 15 bp, Artificial Sequence
  Description of Artificial Sequence: Synthetic oligonucleotide
gtctgggaagtgagg

SEQ ID NO: 466 - DNA, 15 bp, Artificial Sequence
  Description of Artificial Sequence: Synthetic oligonucleotide
gtgtacccagcgacc

SEQ ID NO: 467 - DNA, 15 bp, Artificial Sequence
  Description of Artificial Sequence: Synthetic oligonucleotide
ggaaaagaaagagag

SEQ ID NO: 468 - DNA, 15 bp, Artificial Sequence
  Description of Artificial Sequence: Synthetic oligonucleotide
ctgcctggccgccca

SEQ ID NO: 469 - DNA, 15 bp, Artificial Sequence
  Description of Artificial Sequence: Synthetic oligonucleotide
tctgcccggccaccg

SEQ ID NO: 470 - DNA, 15 bp, Artificial Sequence
  Description of Artificial Sequence: Synthetic oligonucleotide
cggagtctcgctcac

SEQ ID NO: 471 - DNA, 15 bp, Artificial Sequence
  Description of Artificial Sequence: Synthetic oligonucleotide
gctgttgatctgtga

SEQ ID NO: 472 - DNA, 15 bp, Artificial Sequence
  Description of Artificial Sequence: Synthetic oligonucleotide
tctgcccggccacca

SEQ ID NO: 473 - DNA, 15 bp, Artificial Sequence
  Description of Artificial Sequence: Synthetic oligonucleotide
ggggagcacctctgc

SEQ ID NO: 474 - DNA, 15 bp, Artificial Sequence
  Description of Artificial Sequence: Synthetic oligonucleotide
tgccgagccgaggct

SEQ ID NO: 475 - DNA, 15 bp, Artificial Sequence
  Description of Artificial Sequence: Synthetic oligonucleotide
tccctctccctctcc

SEQ ID NO: 476 - DNA, 15 bp, Artificial Sequence
  Description of Artificial Sequence: Synthetic oligonucleotide
aggcagcatgctcgt

SEQ ID NO: 477 - DNA, 15 bp, Artificial Sequence
  Description of Artificial Sequence: Synthetic oligonucleotide
gagtgatctgcccgc

SEQ ID NO: 478 - DNA, 15 bp, Artificial Sequence
  Description of Artificial Sequence: Synthetic oligonucleotide
gcccggccagccgcc

SEQ ID NO: 479 - DNA, 15 bp, Artificial Sequence
  Description of Artificial Sequence: Synthetic oligonucleotide
cggtactgctgccat

SEQ ID NO: 480 - DNA, 15 bp, Artificial Sequence
  Description of Artificial Sequence: Synthetic oligonucleotide
tcagcctgccgagtg

SEQ ID NO: 481 - DNA, 15 bp, Artificial Sequence
  Description of Artificial Sequence: Synthetic oligonucleotide
ccctctttctacggt

SEQ ID NO: 482 - DNA, 15 bp, Artificial Sequence
  Description of Artificial Sequence: Synthetic oligonucleotide
tgccttgggatcctg

SEQ ID NO: 483 - DNA, 15 bp, Artificial Sequence
  Description of Artificial Sequence: Synthetic oligonucleotide
gaggggcgcctctgc

SEQ ID NO: 484 - DNA, 15 bp, Artificial Sequence
  Description of Artificial Sequence: Synthetic oligonucleotide
tccgcccggccgcca

SEQ ID NO: 485 - DNA, 15 bp, Artificial Sequence
  Description of Artificial Sequence: Synthetic oligonucleotide
accttccctccacta

SEQ ID NO: 486 - DNA, 15 bp, Artificial Sequence
  Description of Artificial Sequence: Synthetic oligonucleotide
ctgggattgcaggcg

SEQ ID NO: 487 - DNA, 15 bp, Artificial Sequence
  Description of Artificial Sequence: Synthetic oligonucleotide
gttaatctataacct

SEQ ID NO: 488 - DNA, 15 bp, Artificial Sequence
  Description of Artificial Sequence: Synthetic oligonucleotide
tgtggggagcacctc

SEQ ID NO: 489 - DNA, 15 bp, Artificial Sequence
  Description of Artificial Sequence: Synthetic oligonucleotide
gctgtgttggccggg

SEQ ID NO: 490 - DNA, 15 bp, Artificial Sequence
  Description of Artificial Sequence: Synthetic oligonucleotide
ccccttctgggaagt

SEQ ID NO: 491 - DNA, 15 bp, Artificial Sequence
  Description of Artificial Sequence: Synthetic oligonucleotide
ccagcccctaaccgc

SEQ ID NO: 492 - DNA, 15 bp, Artificial Sequence
  Description of Artificial Sequence: Synthetic oligonucleotide
agatgtggggagcgc

SEQ ID NO: 493 - DNA, 15 bp, Artificial Sequence
  Description of Artificial Sequence: Synthetic oligonucleotide
tctcgttcactcagt

SEQ ID NO: 494 - DNA, 15 bp, Artificial Sequence
  Description of Artificial Sequence: Synthetic oligonucleotide
ctggacggtactgct

SEQ ID NO: 495 - DNA, 15 bp, Artificial Sequence
  Description of Artificial Sequence: Synthetic oligonucleotide
gggggtcagcccccc

SEQ ID NO: 496 - DNA, 15 bp, Artificial Sequence
  Description of Artificial Sequence: Synthetic oligonucleotide
gaaaggcgggaaggg

SEQ ID NO: 497 - DNA, 15 bp, Artificial Sequence
  Description of Artificial Sequence: Synthetic oligonucleotide
ataaaaaaaaaaaaa

SEQ ID NO: 498 - DNA, 15 bp, Artificial Sequence
  Description of Artificial Sequence: Synthetic oligonucleotide
ggttttggtggagac

SEQ ID NO: 499 - DNA, 15 bp, Artificial Sequence
  Description of Artificial Sequence: Synthetic oligonucleotide
tgccgagccgaagct

SEQ ID NO: 500 - DNA, 15 bp, Artificial Sequence
  Description of Artificial Sequence: Synthetic oligonucleotide
agagatcagattgtt

SEQ ID NO: 501 - DNA, 15 bp, Artificial Sequence
  Description of Artificial Sequence: Synthetic oligonucleotide
gaagtagacatagga

SEQ ID NO: 502 - DNA, 15 bp, Artificial Sequence
  Description of Artificial Sequence: Synthetic oligonucleotide
gaagggtggggaaaa

SEQ ID NO: 503 - DNA, 15 bp, Artificial Sequence
  Description of Artificial Sequence: Synthetic oligonucleotide
cagcggctcattggg

SEQ ID NO: 504 - DNA, 15 bp, Artificial Sequence
  Description of Artificial Sequence: Synthetic oligonucleotide
ggaagggtggggaaa

SEQ ID NO: 505 - DNA, 15 bp, Artificial Sequence
  Description of Artificial Sequence: Synthetic oligonucleotide
ccccgtctgggagga

SEQ ID NO: 506 - DNA, 15 bp, Artificial Sequence
  Description of Artificial Sequence: Synthetic oligonucleotide
cacatccccctctcc

SEQ ID NO: 507 - DNA, 15 bp, Artificial Sequence
  Description of Artificial Sequence: Synthetic oligonucleotide
gcctcccaaagtgct

SEQ ID NO: 508 - DNA, 15 bp, Artificial Sequence
  Description of Artificial Sequence: Synthetic oligonucleotide
gagaaatcggatggt

SEQ ID NO: 509 - DNA, 15 bp, Artificial Sequence
  Description of Artificial Sequence: Synthetic oligonucleotide
gccccccgcccggcc

SEQ ID NO: 510 - DNA, 15 bp, Artificial Sequence
  Description of Artificial Sequence: Synthetic oligonucleotide
cgaccattgagaacg

SEQ ID NO: 511 - DNA, 15 bp, Artificial Sequence
  Description of Artificial Sequence: Synthetic oligonucleotide
tcccaaagtgccgag

SEQ ID NO: 512 - DNA, 15 bp, Artificial Sequence
  Description of Artificial Sequence: Synthetic oligonucleotide
ccccgtctgggaggt

SEQ ID NO: 513 - DNA, 15 bp, Artificial Sequence
  Description of Artificial Sequence: Synthetic oligonucleotide
cacccaagaattatc

SEQ ID NO: 514 - DNA, 15 bp, Artificial Sequence
  Description of Artificial Sequence: Synthetic oligonucleotide
gcctcccaaagtgcc

SEQ ID NO: 515 - DNA, 15 bp, Artificial Sequence
  Description of Artificial Sequence: Synthetic oligonucleotide
tccctaatcttaagt

SEQ ID NO: 516 - DNA, 15 bp, Artificial Sequence
  Description of Artificial Sequence: Synthetic oligonucleotide
cgggaaaggtgggga

SEQ ID NO: 517 - DNA, 15 bp, Artificial Sequence
  Description of Artificial Sequence: Synthetic oligonucleotide
ttctgccttgggatc

SEQ ID NO: 518 - DNA, 15 bp, Artificial Sequence
  Description of Artificial Sequence: Synthetic oligonucleotide
agccccccgcccggc

SEQ ID NO: 519 - DNA, 15 bp, Artificial Sequence
  Description of Artificial Sequence: Synthetic oligonucleotide
ccaggctggagtgca

SEQ ID NO: 520 - DNA, 15 bp, Artificial Sequence
  Description of Artificial Sequence: Synthetic oligonucleotide
agaaatcggatggtt

SEQ ID NO: 521 - DNA, 15 bp, Artificial Sequence
  Description of Artificial Sequence: Synthetic oligonucleotide
aaaattgagaaatcg

SEQ ID NO: 522 - DNA, 15 bp, Artificial Sequence
  Description of Artificial Sequence: Synthetic oligonucleotide
tctgccttgggatcc

SEQ ID NO: 523 - DNA, 15 bp, Artificial Sequence
  Description of Artificial Sequence: Synthetic oligonucleotide
gcctggccgcccatc

SEQ ID NO: 524 - DNA, 15 bp, Artificial Sequence
  Description of Artificial Sequence: Synthetic oligonucleotide
gattaagggcggtgc

SEQ ID NO: 525 - DNA, 15 bp, Artificial Sequence
  Description of Artificial Sequence: Synthetic oligonucleotide
gccgccccttctggg

SEQ ID NO: 526 - DNA, 15 bp, Artificial Sequence
  Description of Artificial Sequence: Synthetic oligonucleotide
cagccccccgcccgg

SEQ ID NO: 527 - DNA, 15 bp, Artificial Sequence
  Description of Artificial Sequence: Synthetic oligonucleotide
gcgccgccacgcctg

SEQ ID NO: 528 - DNA, 15 bp, Artificial Sequence
  Description of Artificial Sequence: Synthetic oligonucleotide
ctgcccggccgccca

SEQ ID NO: 529 - DNA, 15 bp, Artificial Sequence
  Description of Artificial Sequence: Synthetic oligonucleotide
cccctctgcctggct

SEQ ID NO: 530 - DNA, 15 bp, Artificial Sequence
  Description of Artificial Sequence: Synthetic oligonucleotide
ctgcccggccgcccc

SEQ ID NO: 531 - DNA, 15 bp, Artificial Sequence
  Description of Artificial Sequence: Synthetic oligonucleotide
caggcgcgcgccgcc

SEQ ID NO: 532 - DNA, 15 bp, Artificial Sequence
  Description of Artificial Sequence: Synthetic oligonucleotide
gctacaacctacacc

SEQ ID NO: 533 - DNA, 15 bp, Artificial Sequence
  Description of Artificial Sequence: Synthetic oligonucleotide
ggtcagccccccgcc

SEQ ID NO: 534 - DNA, 15 bp, Artificial Sequence
  Description of Artificial Sequence: Synthetic oligonucleotide
tgatctgtgacctta

SEQ ID NO: 535 - DNA, 15 bp, Artificial Sequence
  Description of Artificial Sequence: Synthetic oligonucleotide
taagtacccagggac

SEQ ID NO: 536 - DNA, 15 bp, Artificial Sequence
  Description of Artificial Sequence: Synthetic oligonucleotide
gttgaccgggctggt

SEQ ID NO: 537 - DNA, 15 bp, Artificial Sequence
  Description of Artificial Sequence: Synthetic oligonucleotide
tggccgcccagtctg

SEQ ID NO: 538 - DNA, 15 bp, Artificial Sequence
  Description of Artificial Sequence: Synthetic oligonucleotide
gcggaaggccgcagg

SEQ ID NO: 539 - DNA, 15 bp, Artificial Sequence
  Description of Artificial Sequence: Synthetic oligonucleotide
tactgggaagtgagg

SEQ ID NO: 540 - DNA, 15 bp, Artificial Sequence
  Description of Artificial Sequence: Synthetic oligonucleotide
ttcgtatttttttgg

SEQ ID NO: 541 - DNA, 15 bp, Artificial Sequence
  Description of Artificial Sequence: Synthetic oligonucleotide
gggaaaggtggggaa

SEQ ID NO: 542 - DNA, 15 bp, Artificial Sequence
  Description of Artificial Sequence: Synthetic oligonucleotide
cgagtgcctgcgatt

SEQ ID NO: 543 - DNA, 15 bp, Artificial Sequence
  Description of Artificial Sequence: Synthetic oligonucleotide
acctctgcctaggaa

SEQ ID NO: 544 - DNA, 15 bp, Artificial Sequence
  Description of Artificial Sequence: Synthetic oligonucleotide
cgccacgcctgactg

SEQ ID NO: 545 - DNA, 15 bp, Artificial Sequence
  Description of Artificial Sequence: Synthetic oligonucleotide
ccttggcctcccaaa

SEQ ID NO: 546 - DNA, 15 bp, Artificial Sequence
  Description of Artificial Sequence: Synthetic oligonucleotide
tcaataaatactaaa

SEQ ID NO: 547 - DNA, 15 bp, Artificial Sequence
  Description of Artificial Sequence: Synthetic oligonucleotide
aaaattaaaaaaaaa

SEQ ID NO: 548 - DNA, 15 bp, Artificial Sequence
  Description of Artificial Sequence: Synthetic oligonucleotide
ctcagtgctcaatgg

SEQ ID NO: 549 - DNA, 15 bp, Artificial Sequence
  Description of Artificial Sequence: Synthetic oligonucleotide
cgtctctgcctggcc

SEQ ID NO: 550 - DNA, 15 bp, Artificial Sequence
  Description of Artificial Sequence: Synthetic oligonucleotide
actgccgccatctcg

SEQ ID NO: 551 - DNA, 15 bp, Artificial Sequence
  Description of Artificial Sequence: Synthetic oligonucleotide
ttgttgctgtgtctg

SEQ ID NO: 552 - DNA, 15 bp, Artificial Sequence
  Description of Artificial Sequence: Synthetic oligonucleotide
tcggattgttgctgt

SEQ ID NO: 553 - DNA, 15 bp, Artificial Sequence
  Description of Artificial Sequence: Synthetic oligonucleotide
cctgttgatctgtga

SEQ ID NO: 554 - DNA, 15 bp, Artificial Sequence
  Description of Artificial Sequence: Synthetic oligonucleotide
cttcccggccgccat

SEQ ID NO: 555 - DNA, 15 bp, Artificial Sequence
  Description of Artificial Sequence: Synthetic oligonucleotide
ataggagactccatt

SEQ ID NO: 556 - DNA, 15 bp, Artificial Sequence
  Description of Artificial Sequence: Synthetic oligonucleotide
gccaccccgtctggg

SEQ ID NO: 557 - DNA, 15 bp, Artificial Sequence
  Description of Artificial Sequence: Synthetic oligonucleotide
tgtggaatagaaagg

SEQ ID NO: 558 - DNA, 15 bp, Artificial Sequence
  Description of Artificial Sequence: Synthetic oligonucleotide
ccgcagggacctctg

SEQ ID NO: 559 - DNA, 15 bp, Artificial Sequence
  Description of Artificial Sequence: Synthetic oligonucleotide
cgcctccgcccggcc

SEQ ID NO: 560 - DNA, 15 bp, Artificial Sequence
  Description of Artificial Sequence: Synthetic oligonucleotide
ccctaatctcaagta

SEQ ID NO: 561 - DNA, 15 bp, Artificial Sequence
  Description of Artificial Sequence: Synthetic oligonucleotide
agacatgggagactt

SEQ ID NO: 562 - DNA, 15 bp, Artificial Sequence
  Description of Artificial Sequence: Synthetic oligonucleotide
atctcaagtacccag

SEQ ID NO: 563 - DNA, 15 bp, Artificial Sequence
  Description of Artificial Sequence: Synthetic oligonucleotide
acactgcggaaggcc

SEQ ID NO: 564 - DNA, 15 bp, Artificial Sequence
  Description of Artificial Sequence: Synthetic oligonucleotide
ttgccgggtctgtgt

SEQ ID NO: 565 - DNA, 15 bp, Artificial Sequence
  Description of Artificial Sequence: Synthetic oligonucleotide
tcgctgtgttgaccg

SEQ ID NO: 566 - DNA, 15 bp, Artificial Sequence
  Description of Artificial Sequence: Synthetic oligonucleotide
cccagggacacaaac

SEQ ID NO: 567 - DNA, 15 bp, Artificial Sequence
  Description of Artificial Sequence: Synthetic oligonucleotide
ctgccttgggatcct

SEQ ID NO: 568 - DNA, 15 bp, Artificial Sequence
  Description of Artificial Sequence: Synthetic oligonucleotide
gggccatgatgacaa

SEQ ID NO: 569 - DNA, 15 bp, Artificial Sequence
  Description of Artificial Sequence: Synthetic oligonucleotide
tgcctgggattgcag

SEQ ID NO: 570 - DNA, 15 bp, Artificial Sequence
  Description of Artificial Sequence: Synthetic oligonucleotide
ctgtgtctgtgtaga

SEQ ID NO: 571 - DNA, 15 bp, Artificial Sequence
  Description of Artificial Sequence: Synthetic oligonucleotide
tccattttgttctgt

SEQ ID NO: 572 - DNA, 15 bp, Artificial Sequence
  Description of Artificial Sequence: Synthetic oligonucleotide
atggttgccgggtct

SEQ ID NO: 573 - DNA, 15 bp, Artificial Sequence
  Description of Artificial Sequence: Synthetic oligonucleotide
cgggaggtggggggg

SEQ ID NO: 574 - DNA, 15 bp, Artificial Sequence
  Description of Artificial Sequence: Synthetic oligonucleotide
aaatgtggggaaaag

SEQ ID NO: 575 - DNA, 15 bp, Artificial Sequence
  Description of Artificial Sequence: Synthetic oligonucleotide
ctcggcctgccgagt

SEQ ID NO: 576 - DNA, 15 bp, Artificial Sequence
  Description of Artificial Sequence: Synthetic oligonucleotide
tgccatctcggctca

SEQ ID NO: 577 - DNA, 15 bp, Artificial Sequence
  Description of Artificial Sequence: Synthetic oligonucleotide
ccaaagtgccgagat

SEQ ID NO: 578 - DNA, 15 bp, Artificial Sequence
  Description of Artificial Sequence: Synthetic oligonucleotide
ccgccccttctggga

SEQ ID NO: 579 - DNA, 15 bp, Artificial Sequence
  Description of Artificial Sequence: Synthetic oligonucleotide
ggaaaagatagagaa

SEQ ID NO: 580 - DNA, 15 bp, Artificial Sequence
  Description of Artificial Sequence: Synthetic oligonucleotide
ggtggggaaaagata

SEQ ID NO: 581 - DNA, 15 bp, Artificial Sequence
  Description of Artificial Sequence: Synthetic oligonucleotide
tgctgtgtcaactca

SEQ ID NO: 582 - DNA, 15 bp, Artificial Sequence
  Description of Artificial Sequence: Synthetic oligonucleotide
cttttcattttgttc

SEQ ID NO: 583 - DNA, 15 bp, Artificial Sequence
  Description of Artificial Sequence: Synthetic oligonucleotide
gacataggagactcc

SEQ ID NO: 584 - DNA, 15 bp, Artificial Sequence
  Description of Artificial Sequence: Synthetic oligonucleotide
cccgtctgggaggtg

SEQ ID NO: 585 - DNA, 15 bp, Artificial Sequence
  Description of Artificial Sequence: Synthetic oligonucleotide
gggaaaaaattgaga

SEQ ID NO: 586 - DNA, 15 bp, Artificial Sequence
  Description of Artificial Sequence: Synthetic oligonucleotide
gactgtactgccgcc

SEQ ID NO: 587 - DNA, 15 bp, Artificial Sequence
  Description of Artificial Sequence: Synthetic oligonucleotide
ccccgtgctctctga

SEQ ID NO: 588 - DNA, 15 bp, Artificial Sequence
  Description of Artificial Sequence: Synthetic oligonucleotide
gattctcctgcctcg

SEQ ID NO: 589 - DNA, 15 bp, Artificial Sequence
  Description of Artificial Sequence: Synthetic oligonucleotide
ccggccgccaccccg

SEQ ID NO: 590 - DNA, 15 bp, Artificial Sequence
  Description of Artificial Sequence: Synthetic oligonucleotide
ggtggggaaaagatt

SEQ ID NO: 591 - DNA, 15 bp, Artificial Sequence
  Description of Artificial Sequence: Synthetic oligonucleotide
gccgaagctggactg

SEQ ID NO: 592 - DNA, 15 bp, Artificial Sequence
  Description of Artificial Sequence: Synthetic oligonucleotide
acagatgcttgaagg

SEQ ID NO: 593 - DNA, 15 bp, Artificial Sequence
  Description of Artificial Sequence: Synthetic oligonucleotide
ggtttttgtattttt

SEQ ID NO: 594 - DNA, 15 bp, Artificial Sequence
  Description of Artificial Sequence: Synthetic oligonucleotide
attaagggcggtgca

SEQ ID NO: 595 - DNA, 15 bp, Artificial Sequence
  Description of Artificial Sequence: Synthetic oligonucleotide
ggagtctggttcact

SEQ ID NO: 596 - DNA, 15 bp, Artificial Sequence
  Description of Artificial Sequence: Synthetic oligonucleotide
gtattttttggtgga

SEQ ID NO: 597 - DNA, 15 bp, Artificial Sequence
  Description of Artificial Sequence: Synthetic oligonucleotide
ccgggaggaggtggg

SEQ ID NO: 598 - DNA, 15 bp, Artificial Sequence
  Description of Artificial Sequence: Synthetic oligonucleotide
tggagtgcagtggcg

SEQ ID NO: 599 - DNA, 15 bp, Artificial Sequence
  Description of Artificial Sequence: Synthetic oligonucleotide
aaatactaaaaaaaa

SEQ ID NO: 600 - DNA, 15 bp, Artificial Sequence
  Description of Artificial Sequence: Synthetic oligonucleotide
atccccaaccctgtg

SEQ ID NO: 601 - DNA, 15 bp, Artificial Sequence
  Description of Artificial Sequence: Synthetic oligonucleotide
ccgtccgggaggagg

SEQ ID NO: 602 - DNA, 15 bp, Artificial Sequence
  Description of Artificial Sequence: Synthetic oligonucleotide
gcccggccgcccagt

SEQ ID NO: 603 - DNA, 15 bp, Artificial Sequence
  Description of Artificial Sequence: Synthetic oligonucleotide
agaacgggccatgat

SEQ ID NO: 604 - DNA, 15 bp, Artificial Sequence
  Description of Artificial Sequence: Synthetic oligonucleotide
agcgcctcttcccgg

SEQ ID NO: 605 - DNA, 15 bp, Artificial Sequence
  Description of Artificial Sequence: Synthetic oligonucleotide
ctttgttcacgtgtt

SEQ ID NO: 606 - DNA, 15 bp, Artificial Sequence
  Description of Artificial Sequence: Synthetic oligonucleotide
ggaaaaaattgagaa

SEQ ID NO: 607 - DNA, 15 bp, Artificial Sequence
  Description of Artificial Sequence: Synthetic oligonucleotide
tgtactgccgccatc

SEQ ID NO: 608 - DNA, 15 bp, Artificial Sequence
  Description of Artificial Sequence: Synthetic oligonucleotide
agccgcctgccttgg

SEQ ID NO: 609 - DNA, 15 bp, Artificial Sequence
  Description of Artificial Sequence: Synthetic oligonucleotide
aaagaaagagagatc

SEQ ID NO: 610 - DNA, 15 bp, Artificial Sequence
  Description of Artificial Sequence: Synthetic oligonucleotide
gcgtctctgcccggc

SEQ ID NO: 611 - DNA, 15 bp, Artificial Sequence
  Description of Artificial Sequence: Synthetic oligonucleotide
tggatagaagtagac

SEQ ID NO: 612 - DNA, 15 bp, Artificial Sequence
  Description of Artificial Sequence: Synthetic oligonucleotide
atgtggggagcacct

SEQ ID NO: 613 - DNA, 15 bp, Artificial Sequence
  Description of Artificial Sequence: Synthetic oligonucleotide
gacacaaacactgcg

SEQ ID NO: 614 - DNA, 15 bp, Artificial Sequence
  Description of Artificial Sequence: Synthetic oligonucleotide
tccagctcctggcct

SEQ ID NO: 615 - DNA, 15 bp, Artificial Sequence
  Description of Artificial Sequence: Synthetic oligonucleotide
ggatgacaatggcgg

SEQ ID NO: 616 - DNA, 15 bp, Artificial Sequence
  Description of Artificial Sequence: Synthetic oligonucleotide
aattcttctgccttg

SEQ ID NO: 617 - DNA, 15 bp, Artificial Sequence
  Description of Artificial Sequence: Synthetic oligonucleotide
gatcaataaaaaaaa

SEQ ID NO: 618 - DNA, 15 bp, Artificial Sequence
  Description of Artificial Sequence: Synthetic oligonucleotide
ctaatctcaagtacc

SEQ ID NO: 619 - DNA, 15 bp, Artificial Sequence
  Description of Artificial Sequence: Synthetic oligonucleotide
acaaccacctcccag

SEQ ID NO: 620 - DNA, 15 bp, Artificial Sequence
  Description of Artificial Sequence: Synthetic oligonucleotide
gcccctaaccgcgag

SEQ ID NO: 621 - DNA, 15 bp, Artificial Sequence
  Description of Artificial Sequence: Synthetic oligonucleotide
gactggttttcgtat

SEQ ID NO: 622 - DNA, 15 bp, Artificial Sequence
  Description of Artificial Sequence: Synthetic oligonucleotide
cgggccatgatgaca

SEQ ID NO: 623 - DNA, 15 bp, Artificial Sequence
  Description of Artificial Sequence: Synthetic oligonucleotide
ctcctgcctcggcct

SEQ ID NO: 624 - DNA, 15 bp, Artificial Sequence
  Description of Artificial Sequence: Synthetic oligonucleotide
cgggccatgatgacg

SEQ ID NO: 625 - DNA, 15 bp, Artificial Sequence
  Description of Artificial Sequence: Synthetic oligonucleotide
ccctctcatgcggag

SEQ ID NO: 626 - DNA, 15 bp, Artificial Sequence
  Description of Artificial Sequence: Synthetic oligonucleotide
tagaaaggcgggaaa

SEQ ID NO: 627 - DNA, 15 bp, Artificial Sequence
  Description of Artificial Sequence: Synthetic oligonucleotide
tagaaaggcgggaag

SEQ ID NO: 628 - DNA, 15 bp, Artificial Sequence
  Description of Artificial Sequence: Synthetic oligonucleotide
atctcggctcactgc

SEQ ID NO: 629 - DNA, 15 bp, Artificial Sequence
  Description of Artificial Sequence: Synthetic oligonucleotide
tcccggccgccatcc

SEQ ID NO: 630 - DNA, 15 bp, Artificial Sequence
  Description of Artificial Sequence: Synthetic oligonucleotide
ggaggtgggggggtc

SEQ ID NO: 631 - DNA, 15 bp, Artificial Sequence
  Description of Artificial Sequence: Synthetic oligonucleotide
gttgccgaggctgga

SEQ ID NO: 632 - DNA, 15 bp, Artificial Sequence
  Description of Artificial Sequence: Synthetic oligonucleotide
ctcgttaagagtcat

SEQ ID NO: 633 - DNA, 15 bp, Artificial Sequence
  Description of Artificial Sequence: Synthetic oligonucleotide
tctgatgccgagcca

SEQ ID NO: 634 - DNA, 15 bp, Artificial Sequence
  Description of Artificial Sequence: Synthetic oligonucleotide
atgatgacgatggcg

SEQ ID NO: 635 - DNA, 15 bp, Artificial Sequence
  Description of Artificial Sequence: Synthetic oligonucleotide
tctgatgccgagccg

SEQ ID NO: 636 - DNA, 15 bp, Artificial Sequence
  Description of Artificial Sequence: Synthetic oligonucleotide
ccttctgggaagtga

SEQ ID NO: 637 - DNA, 15 bp, Artificial Sequence
  Description of Artificial Sequence: Synthetic oligonucleotide
actcagggttaaatg

SEQ ID NO: 638 - DNA, 15 bp, Artificial Sequence
  Description of Artificial Sequence: Synthetic oligonucleotide
attcttctgccttgg

SEQ ID NO: 639 - DNA, 15 bp, Artificial Sequence
  Description of Artificial Sequence: Synthetic oligonucleotide
tgcgagaaacaccca

SEQ ID NO: 640 - DNA, 15 bp, Artificial Sequence
  Description of Artificial Sequence: Synthetic oligonucleotide
gcctcccgaggtgct

SEQ ID NO: 641 - DNA, 15 bp, Artificial Sequence
  Description of Artificial Sequence: Synthetic oligonucleotide
tcacatgtttatctg

SEQ ID NO: 642 - DNA, 15 bp, Artificial Sequence
  Description of Artificial Sequence: Synthetic oligonucleotide
ggattaagggcggtg

SEQ ID NO: 643 - DNA, 15 bp, Artificial Sequence
  Description of Artificial Sequence: Synthetic oligonucleotide
ccactcagggttaaa

SEQ ID NO: 644 - DNA, 15 bp, Artificial Sequence
  Description of Artificial Sequence: Synthetic oligonucleotide
ttgttaaacagatgc

SEQ ID NO: 645 - DNA, 15 bp, Artificial Sequence
  Description of Artificial Sequence: Synthetic oligonucleotide
gcctcccgaggtgcc

SEQ ID NO: 646 - DNA, 15 bp, Artificial Sequence
  Description of Artificial Sequence: Synthetic oligonucleotide
atcccgtctgggaag

SEQ ID NO: 647 - DNA, 15 bp, Artificial Sequence
  Description of Artificial Sequence: Synthetic oligonucleotide
ggaggtgtacccaac

SEQ ID NO: 648 - DNA, 15 bp, Artificial Sequence
  Description of Artificial Sequence: Synthetic oligonucleotide
tttctacggtctccc

SEQ ID NO: 649 - DNA, 15 bp, Artificial Sequence
  Description of Artificial Sequence: Synthetic oligonucleotide
ctgtgtagaaagagg

SEQ ID NO: 650 - DNA, 15 bp, Artificial Sequence
  Description of Artificial Sequence: Synthetic oligonucleotide
actccctaatcttaa

SEQ ID NO: 651 - DNA, 15 bp, Artificial Sequence
  Description of Artificial Sequence: Synthetic oligonucleotide
aacctccacctccca

SEQ ID NO: 652 - DNA, 15 bp, Artificial Sequence
  Description of Artificial Sequence: Synthetic oligonucleotide
ttttgttctgtacta

SEQ ID NO: 653 - DNA, 15 bp, Artificial Sequence
  Description of Artificial Sequence: Synthetic oligonucleotide
tcggatggttgccgt

SEQ ID NO: 654 - DNA, 15 bp, Artificial Sequence
  Description of Artificial Sequence: Synthetic oligonucleotide
cagcctctgcccggc

SEQ ID NO: 655 - DNA, 15 bp, Artificial Sequence
  Description of Artificial Sequence: Synthetic oligonucleotide
gccagccgccccgtc

SEQ ID NO: 656 - DNA, 15 bp, Artificial Sequence
  Description of Artificial Sequence: Synthetic oligonucleotide
gtcaactcagggtta

SEQ ID NO: 657 - DNA, 15 bp, Artificial Sequence
  Description of Artificial Sequence: Synthetic oligonucleotide
aagaaaagggggaaa

SEQ ID NO: 658 - DNA, 15 bp, Artificial Sequence
  Description of Artificial Sequence: Synthetic oligonucleotide
ccctaatcttaagta

SEQ ID NO: 659 - DNA, 15 bp, Artificial Sequence
  Description of Artificial Sequence: Synthetic oligonucleotide
agtagacataggaga

SEQ ID NO: 660 - DNA, 15 bp, Artificial Sequence
  Description of Artificial Sequence: Synthetic oligonucleotide
gccgggccggtctcc

SEQ ID NO: 661 - DNA, 15 bp, Artificial Sequence
  Description of Artificial Sequence: Synthetic oligonucleotide
cggtctccctctgtt

SEQ ID NO: 662 - DNA, 15 bp, Artificial Sequence
  Description of Artificial Sequence: Synthetic oligonucleotide
tactaagaaaaattc

SEQ ID NO: 663 - DNA, 15 bp, Artificial Sequence
  Description of Artificial Sequence: Synthetic oligonucleotide
ggttttcgtattttt

SEQ ID NO: 664 - DNA, 15 bp, Artificial Sequence
  Description of Artificial Sequence: Synthetic oligonucleotide
aggaagtgaggagcg

SEQ ID NO: 665 - DNA, 15 bp, Artificial Sequence
  Description of Artificial Sequence: Synthetic oligonucleotide
cagtctgggaagtga

SEQ ID NO: 666 - DNA, 15 bp, Artificial Sequence
  Description of Artificial Sequence: Synthetic oligonucleotide
acatgggagacttca

SEQ ID NO: 667 - DNA, 15 bp, Artificial Sequence
  Description of Artificial Sequence: Synthetic oligonucleotide
caccactccctaatc

SEQ ID NO: 668 - DNA, 15 bp, Artificial Sequence
  Description of Artificial Sequence: Synthetic oligonucleotide
tcgctacaaccacct

SEQ ID NO: 669 - DNA, 15 bp, Artificial Sequence
  Description of Artificial Sequence: Synthetic oligonucleotide
gtcatcaccactccc

SEQ ID NO: 670 - DNA, 15 bp, Artificial Sequence
  Description of Artificial Sequence: Synthetic oligonucleotide
tggactgtactgctg

SEQ ID NO: 671 - DNA, 15 bp, Artificial Sequence
  Description of Artificial Sequence: Synthetic oligonucleotide
ggcctcccaaagagc

SEQ ID NO: 672 - DNA, 15 bp, Artificial Sequence
  Description of Artificial Sequence: Synthetic oligonucleotide
ttcgctgtgttgacc

SEQ ID NO: 673 - DNA, 15 bp, Artificial Sequence
  Description of Artificial Sequence: Synthetic oligonucleotide
tcgttaagagtcatc

SEQ ID NO: 674 - DNA, 15 bp, Artificial Sequence
  Description of Artificial Sequence: Synthetic oligonucleotide
gaaaagaaagagaga

SEQ ID NO: 675 - DNA, 15 bp, Artificial Sequence
  Description of Artificial Sequence: Synthetic oligonucleotide
ggatgggccatgatg

SEQ ID NO: 676 - DNA, 15 bp, Artificial Sequence
  Description of Artificial Sequence: Synthetic oligonucleotide
ccgagccaaagctgg

SEQ ID NO: 677 - DNA, 15 bp, Artificial Sequence
  Description of Artificial Sequence: Synthetic oligonucleotide
cctctccctgtcccc

SEQ ID NO: 678 - DNA, 15 bp, Artificial Sequence
  Description of Artificial Sequence: Synthetic oligonucleotide
tttgttcacatgttt

SEQ ID NO: 679 - DNA, 15 bp, Artificial Sequence
  Description of Artificial Sequence: Synthetic oligonucleotide
ggccgcccctactgg

SEQ ID NO: 680 - DNA, 15 bp, Artificial Sequence
  Description of Artificial Sequence: Synthetic oligonucleotide
ctgccgagtgcctgc

SEQ ID NO: 681 - DNA, 15 bp, Artificial Sequence
  Description of Artificial Sequence: Synthetic oligonucleotide
ggccaggatgacaat

SEQ ID NO: 682 - DNA, 15 bp, Artificial Sequence
  Description of Artificial Sequence: Synthetic oligonucleotide
acggggtttcgctgt

SEQ ID NO: 683 - DNA, 15 bp, Artificial Sequence
  Description of Artificial Sequence: Synthetic oligonucleotide
catgaccctgccaaa

SEQ ID NO: 684 - DNA, 15 bp, Artificial Sequence
  Description of Artificial Sequence: Synthetic oligonucleotide
gtgagaaacacccaa

SEQ ID NO: 685 - DNA, 15 bp, Artificial Sequence
  Description of Artificial Sequence: Synthetic oligonucleotide
cctgtgctctctgaa

SEQ ID NO: 686 - DNA, 15 bp, Artificial Sequence
  Description of Artificial Sequence: Synthetic oligonucleotide
agtaatcagggacac

SEQ ID NO: 687 - DNA, 15 bp, Artificial Sequence
  Description of Artificial Sequence: Synthetic oligonucleotide
ccaaccctgtgctct

SEQ ID NO: 688 - DNA, 15 bp, Artificial Sequence
  Description of Artificial Sequence: Synthetic oligonucleotide
tgagaaatcggatgg

SEQ ID NO: 689 - DNA, 15 bp, Artificial Sequence
  Description of Artificial Sequence: Synthetic oligonucleotide
ccactccctaatctt

SEQ ID NO: 690 - DNA, 15 bp, Artificial Sequence
  Description of Artificial Sequence: Synthetic oligonucleotide
tgctttgttaaacag

SEQ ID NO: 691 - DNA, 15 bp, Artificial Sequence
  Description of Artificial Sequence: Synthetic oligonucleotide
tcaatgttgcccagg

SEQ ID NO: 692 - DNA, 15 bp, Artificial Sequence
  Description of Artificial Sequence: Synthetic oligonucleotide
cccctctctccacgg

SEQ ID NO: 693 - DNA, 15 bp, Artificial Sequence
  Description of Artificial Sequence: Synthetic oligonucleotide
cctctcatgcggagc

SEQ ID NO: 694 - DNA, 15 bp, Artificial Sequence
  Description of Artificial Sequence: Synthetic oligonucleotide
tggcctcgagtgatc

SEQ ID NO: 695 - DNA, 15 bp, Artificial Sequence
  Description of Artificial Sequence: Synthetic oligonucleotide
caaccccgtgctctc

SEQ ID NO: 696 - DNA, 15 bp, Artificial Sequence
  Description of Artificial Sequence: Synthetic oligonucleotide
ccactccctaatctc

SEQ ID NO: 697 - DNA, 15 bp, Artificial Sequence
  Description of Artificial Sequence: Synthetic oligonucleotide
aataaatactaaaaa

SEQ ID NO: 698 - DNA, 15 bp, Artificial Sequence
  Description of Artificial Sequence: Synthetic oligonucleotide
cgtgctctctgaaac

SEQ ID NO: 699 - DNA, 15 bp, Artificial Sequence
  Description of Artificial Sequence: Synthetic oligonucleotide
gccccgtctgggagg

SEQ ID NO: 700 - DNA, 15 bp, Artificial Sequence
  Description of Artificial Sequence: Synthetic oligonucleotide
atgaccctgccaaat

SEQ ID NO: 701 - DNA, 15 bp, Artificial Sequence
  Description of Artificial Sequence: Synthetic oligonucleotide
tgaggagcgcctctg

SEQ ID NO: 702 - DNA, 15 bp, Artificial Sequence
  Description of Artificial Sequence: Synthetic oligonucleotide
gaggtgaggggcgcc

SEQ ID NO: 703 - DNA, 15 bp, Artificial Sequence
  Description of Artificial Sequence: Synthetic oligonucleotide
aatcagggacacaaa

SEQ ID NO: 704 - DNA, 15 bp, Artificial Sequence
  Description of Artificial Sequence: Synthetic oligonucleotide
tgaggagcgcctctt

SEQ ID NO: 705 - DNA, 15 bp, Artificial Sequence
  Description of Artificial Sequence: Synthetic oligonucleotide
ctgggattgcagacg

SEQ ID NO: 706 - DNA, 15 bp, Artificial Sequence
  Description of Artificial Sequence: Synthetic oligonucleotide
gcccatcgtctgaga

SEQ ID NO: 707 - DNA, 15 bp, Artificial Sequence
  Description of Artificial Sequence: Synthetic oligonucleotide
tgcctaggaaaacca

SEQ ID NO: 708 - DNA, 15 bp, Artificial Sequence
  Description of Artificial Sequence: Synthetic oligonucleotide
cccatctaggaagtg

SEQ ID NO: 709 - DNA, 15 bp, Artificial Sequence
  Description of Artificial Sequence: Synthetic oligonucleotide
gaaggccgcagggtc

SEQ ID NO: 710 - DNA, 15 bp, Artificial Sequence
  Description of Artificial Sequence: Synthetic oligonucleotide
ggattgcaggcgcgc

SEQ ID NO: 711 - DNA, 15 bp, Artificial Sequence
  Description of Artificial Sequence: Synthetic oligonucleotide
caataaaaaaaaaaa

SEQ ID NO: 712 - DNA, 15 bp, Artificial Sequence
  Description of Artificial Sequence: Synthetic oligonucleotide
gctggagtgcagtgg

SEQ ID NO: 713 - DNA, 15 bp, Artificial Sequence
  Description of Artificial Sequence: Synthetic oligonucleotide
gcccggccgcccctt

SEQ ID NO: 714 - DNA, 15 bp, Artificial Sequence
  Description of Artificial Sequence: Synthetic oligonucleotide
ggctcattggggatg

SEQ ID NO: 715 - DNA, 15 bp, Artificial Sequence
  Description of Artificial Sequence: Synthetic oligonucleotide
tgccgccatctcggc

SEQ ID NO: 716 - DNA, 15 bp, Artificial Sequence
  Description of Artificial Sequence: Synthetic oligonucleotide
agaggtagacatggg

SEQ ID NO: 717 - DNA, 15 bp, Artificial Sequence
  Description of Artificial Sequence: Synthetic oligonucleotide
ggcggctttgtggaa

SEQ ID NO: 718 - DNA, 15 bp, Artificial Sequence
  Description of Artificial Sequence: Synthetic oligonucleotide
cagctcctggcctcg

SEQ ID NO: 719 - DNA, 15 bp, Artificial Sequence
  Description of Artificial Sequence: Synthetic oligonucleotide
tcgtatttttttggt

SEQ ID NO: 720 - DNA, 15 bp, Artificial Sequence
  Description of Artificial Sequence: Synthetic oligonucleotide
gtgcctgcgattgca

SEQ ID NO: 721 - DNA, 15 bp, Artificial Sequence
  Description of Artificial Sequence: Synthetic oligonucleotide
gaaatcggattgttg

SEQ ID NO: 722 - DNA, 15 bp, Artificial Sequence
  Description of Artificial Sequence: Synthetic oligonucleotide
aatggcggctttgtg

SEQ ID NO: 723 - DNA, 15 bp, Artificial Sequence
  Description of Artificial Sequence: Synthetic oligonucleotide
gaaaggggggaaagg

SEQ ID NO: 724 - DNA, 15 bp, Artificial Sequence
  Description of Artificial Sequence: Synthetic oligonucleotide
gccgagccgaggctg

SEQ ID NO: 725 - DNA, 15 bp, Artificial Sequence
  Description of Artificial Sequence: Synthetic oligonucleotide
cactccctaatctca

SEQ ID NO: 726 - DNA, 15 bp, Artificial Sequence
  Description of Artificial Sequence: Synthetic oligonucleotide
ttgccgaggctggac

SEQ ID NO: 727 - DNA, 15 bp, Artificial Sequence
  Description of Artificial Sequence: Synthetic oligonucleotide
tgtcgaaaagaaaag

SEQ ID NO: 728 - DNA, 15 bp, Artificial Sequence
  Description of Artificial Sequence: Synthetic oligonucleotide
cgctgcaacctccct

SEQ ID NO: 729 - DNA, 15 bp, Artificial Sequence
  Description of Artificial Sequence: Synthetic oligonucleotide
gcctgcgattgcagg

SEQ ID NO: 730 - DNA, 15 bp, Artificial Sequence
  Description of Artificial Sequence: Synthetic oligonucleotide
gatagaagtagacat

SEQ ID NO: 731 - DNA, 15 bp, Artificial Sequence
  Description of Artificial Sequence: Synthetic oligonucleotide
cctgccttggcctcc

SEQ ID NO: 732 - DNA, 15 bp, Artificial Sequence
  Description of Artificial Sequence: Synthetic oligonucleotide
tctccagctcctaac

SEQ ID NO: 733 - DNA, 15 bp, Artificial Sequence
  Description of Artificial Sequence: Synthetic oligonucleotide
ggctcactgcaacct

SEQ ID NO: 734 - DNA, 15 bp, Artificial Sequence
  Description of Artificial Sequence: Synthetic oligonucleotide
atagaaaggggggaa

SEQ ID NO: 735 - DNA, 15 bp, Artificial Sequence
  Description of Artificial Sequence: Synthetic oligonucleotide
ggccgccatcccatc

SEQ ID NO: 736 - DNA, 15 bp, Artificial Sequence
  Description of Artificial Sequence: Synthetic oligonucleotide
taatcagggacacaa

SEQ ID NO: 737 - DNA, 15 bp, Artificial Sequence
  Description of Artificial Sequence: Synthetic oligonucleotide
cgctcactcagtgct

SEQ ID NO: 738 - DNA, 15 bp, Artificial Sequence
  Description of Artificial Sequence: Synthetic oligonucleotide
agaagtagacatagg

SEQ ID NO: 739 - DNA, 15 bp, Artificial Sequence
  Description of Artificial Sequence: Synthetic oligonucleotide
aatggtgcccaggct

SEQ ID NO: 740 - DNA, 15 bp, Artificial Sequence
  Description of Artificial Sequence: Synthetic oligonucleotide
cccaagaatgatcaa

SEQ ID NO: 741 - DNA, 15 bp, Artificial Sequence
  Description of Artificial Sequence: Synthetic oligonucleotide
tgtgagaaacaccca

SEQ ID NO: 742 - DNA, 15 bp, Artificial Sequence
  Description of Artificial Sequence: Synthetic oligonucleotide
cactcagtgctcaat

SEQ ID NO: 743 - DNA, 15 bp, Artificial Sequence
  Description of Artificial Sequence: Synthetic oligonucleotide
gtgctgtgtccactc

SEQ ID NO: 744 - DNA, 15 bp, Artificial Sequence
  Description of Artificial Sequence: Synthetic oligonucleotide
ccctctttccacggt

SEQ ID NO: 745 - DNA, 15 bp, Artificial Sequence
  Description of Artificial Sequence: Synthetic oligonucleotide
tgctgccatctcggc

SEQ ID NO: 746 - DNA, 15 bp, Artificial Sequence
  Description of Artificial Sequence: Synthetic oligonucleotide
ggggtttcgccgtgt

SEQ ID NO: 747 - DNA, 15 bp, Artificial Sequence
  Description of Artificial Sequence: Synthetic oligonucleotide
cggttttgtcgaata

SEQ ID NO: 748 - DNA, 15 bp, Artificial Sequence
  Description of Artificial Sequence: Synthetic oligonucleotide
tgatgccgagccgag

SEQ ID NO: 749 - DNA, 15 bp, Artificial Sequence
  Description of Artificial Sequence: Synthetic oligonucleotide
tgatgccgagccgaa

SEQ ID NO: 750 - DNA, 15 bp, Artificial Sequence
  Description of Artificial Sequence: Synthetic oligonucleotide
ctcaagtaatcaggg

SEQ ID NO: 751 - DNA, 15 bp, Artificial Sequence
  Description of Artificial Sequence: Synthetic oligonucleotide
aagctggacggtact

SEQ ID NO: 752 - DNA, 15 bp, Artificial Sequence
  Description of Artificial Sequence: Synthetic oligonucleotide
ctgaaacatgtgctg

SEQ ID NO: 753 - DNA, 15 bp, Artificial Sequence
  Description of Artificial Sequence: Synthetic oligonucleotide
agcgaccattgagaa

SEQ ID NO: 754 - DNA, 15 bp, Artificial Sequence
  Description of Artificial Sequence: Synthetic oligonucleotide
ccctctgtgagaaac

SEQ ID NO: 755 - DNA, 15 bp, Artificial Sequence
  Description of Artificial Sequence: Synthetic oligonucleotide
atctcggctcgctgc

SEQ ID NO: 756 - DNA, 15 bp, Artificial Sequence
  Description of Artificial Sequence: Synthetic oligonucleotide
cagcatgctcgttaa

SEQ ID NO: 757 - DNA, 15 bp, Artificial Sequence
  Description of Artificial Sequence: Synthetic oligonucleotide
atactaaaaaaaaaa

SEQ ID NO: 758 - DNA, 15 bp, Artificial Sequence
  Description of Artificial Sequence: Synthetic oligonucleotide
tgccgagattgcagc

SEQ ID NO: 759 - DNA, 15 bp, Artificial Sequence
  Description of Artificial Sequence: Synthetic oligonucleotide
atctataaccttacc

SEQ ID NO: 760 - DNA, 15 bp, Artificial Sequence
  Description of Artificial Sequence: Synthetic oligonucleotide
gagactccattttgt

SEQ ID NO: 761 - DNA, 15 bp, Artificial Sequence
  Description of Artificial Sequence: Synthetic oligonucleotide
gcctcggcctcccga

SEQ ID NO: 762 - DNA, 15 bp, Artificial Sequence
  Description of Artificial Sequence: Synthetic oligonucleotide
ccgcccatcgtctga

SEQ ID NO: 763 - DNA, 15 bp, Artificial Sequence
  Description of Artificial Sequence: Synthetic oligonucleotide
gtccgggaggaggtg

SEQ ID NO: 764 - DNA, 15 bp, Artificial Sequence
  Description of Artificial Sequence: Synthetic oligonucleotide
tgctctctgaaacat

SEQ ID NO: 765 - DNA, 15 bp, Artificial Sequence
  Description of Artificial Sequence: Synthetic oligonucleotide
ggaggtgtacccagc

SEQ ID NO: 766 - DNA, 15 bp, Artificial Sequence
  Description of Artificial Sequence: Synthetic oligonucleotide
gggatgctgttgatc

SEQ ID NO: 767 - DNA, 15 bp, Artificial Sequence
  Description of Artificial Sequence: Synthetic oligonucleotide
gagccgaagctggac

SEQ ID NO: 768 - DNA, 15 bp, Artificial Sequence
  Description of Artificial Sequence: Synthetic oligonucleotide
tctcccctctttcta

SEQ ID NO: 769 - DNA, 15 bp, Artificial Sequence
  Description of Artificial Sequence: Synthetic oligonucleotide
gagtgatccgccagc

SEQ ID NO: 770 - DNA, 15 bp, Artificial Sequence
  Description of Artificial Sequence: Synthetic oligonucleotide
gggaaaagaaagaga

SEQ ID NO: 771 - DNA, 15 bp, Artificial Sequence
  Description of Artificial Sequence: Synthetic oligonucleotide
tctgccttgggatgc

SEQ ID NO: 772 - DNA, 15 bp, Artificial Sequence
  Description of Artificial Sequence: Synthetic oligonucleotide
catgatgacaatggc

SEQ ID NO: 773 - DNA, 15 bp, Artificial Sequence
  Description of Artificial Sequence: Synthetic oligonucleotide
tcagggacacaaaca

SEQ ID NO: 774 - DNA, 15 bp, Artificial Sequence
  Description of Artificial Sequence: Synthetic oligonucleotide
ggccatgatgacaat

SEQ ID NO: 775 - DNA, 15 bp, Artificial Sequence
  Description of Artificial Sequence: Synthetic oligonucleotide
caagtaatcagggac

SEQ ID NO: 776 - DNA, 15 bp, Artificial Sequence
  Description of Artificial Sequence: Synthetic oligonucleotide
gcgaccattgagaac

SEQ ID NO: 777 - DNA, 15 bp, Artificial Sequence
  Description of Artificial Sequence: Synthetic oligonucleotide
ggcctcccgaggtgc

SEQ ID NO: 778 - DNA, 15 bp, Artificial Sequence
  Description of Artificial Sequence: Synthetic oligonucleotide
gagcgtctctgcctg

SEQ ID NO: 779 - DNA, 15 bp, Artificial Sequence
  Description of Artificial Sequence: Synthetic oligonucleotide
ctccctctcatgcgg

SEQ ID NO: 780 - DNA, 15 bp, Artificial Sequence
  Description of Artificial Sequence: Synthetic oligonucleotide
tgttggccgggctgg

SEQ ID NO: 781 - DNA, 15 bp, Artificial Sequence
  Description of Artificial Sequence: Synthetic oligonucleotide
ccctctccctctccc

SEQ ID NO: 782 - DNA, 15 bp, Artificial Sequence
  Description of Artificial Sequence: Synthetic oligonucleotide
aggagactccatttt

SEQ ID NO: 783 - DNA, 15 bp, Artificial Sequence
  Description of Artificial Sequence: Synthetic oligonucleotide
agaaacacccaagaa

SEQ ID NO: 784 - DNA, 15 bp, Artificial Sequence
  Description of Artificial Sequence: Synthetic oligonucleotide
gtggggggcgcctct

SEQ ID NO: 785 - DNA, 15 bp, Artificial Sequence
  Description of Artificial Sequence: Synthetic oligonucleotide
ccagagacctttgtt

SEQ ID NO: 786 - DNA, 15 bp, Artificial Sequence
  Description of Artificial Sequence: Synthetic oligonucleotide
ggtttcgctgtgttg

SEQ ID NO: 787 - DNA, 15 bp, Artificial Sequence
  Description of Artificial Sequence: Synthetic oligonucleotide
gaggtgtacccagcg

SEQ ID NO: 788 - DNA, 15 bp, Artificial Sequence
  Description of Artificial Sequence: Synthetic oligonucleotide
tggcggctttgtgga

SEQ ID NO: 789 - DNA, 15 bp, Artificial Sequence
  Description of Artificial Sequence: Synthetic oligonucleotide
gcccatcgtctggga

SEQ ID NO: 790 - DNA, 15 bp, Artificial Sequence
  Description of Artificial Sequence: Synthetic oligonucleotide
tgtggggagcgcctc

SEQ ID NO: 791 - DNA, 15 bp, Artificial Sequence
  Description of Artificial Sequence: Synthetic oligonucleotide
ccgtctgggaggagg

SEQ ID NO: 792 - DNA, 15 bp, Artificial Sequence
  Description of Artificial Sequence: Synthetic oligonucleotide
tatccccaaccctgt

SEQ ID NO: 793 - DNA, 15 bp, Artificial Sequence
  Description of Artificial Sequence: Synthetic oligonucleotide
tgtacccagcgacca

SEQ ID NO: 794 - DNA, 15 bp, Artificial Sequence
  Description of Artificial Sequence: Synthetic oligonucleotide
ctccctctccctgtc

SEQ ID NO: 795 - DNA, 15 bp, Artificial Sequence
  Description of Artificial Sequence: Synthetic oligonucleotide
ctcctaaccgcgagt

SEQ ID NO: 796 - DNA, 15 bp, Artificial Sequence
  Description of Artificial Sequence: Synthetic oligonucleotide
taatctcaagtaccc

SEQ ID NO: 797 - DNA, 15 bp, Artificial Sequence
  Description of Artificial Sequence: Synthetic oligonucleotide
ctcccaaagagccgg

SEQ ID NO: 798 - DNA, 15 bp, Artificial Sequence
  Description of Artificial Sequence: Synthetic oligonucleotide
tgcccggccaccacc

SEQ ID NO: 799 - DNA, 15 bp, Artificial Sequence
  Description of Artificial Sequence: Synthetic oligonucleotide
gcgggaaaggtgggg

SEQ ID NO: 800 - DNA, 15 bp, Artificial Sequence
  Description of Artificial Sequence: Synthetic oligonucleotide
ggaggtgaggggcgc

SEQ ID NO: 801 - DNA, 15 bp, Artificial Sequence
  Description of Artificial Sequence: Synthetic oligonucleotide
accagagacctttgt

SEQ ID NO: 802 - DNA, 15 bp, Artificial Sequence
  Description of Artificial Sequence: Synthetic oligonucleotide
gagccaaagctggac

SEQ ID NO: 803 - DNA, 15 bp, Artificial Sequence
  Description of Artificial Sequence: Synthetic oligonucleotide
gtgctgtgtcaactc

SEQ ID NO: 804 - DNA, 15 bp, Artificial Sequence
  Description of Artificial Sequence: Synthetic oligonucleotide
agcgtctctgcctgg

SEQ ID NO: 805 - DNA, 15 bp, Artificial Sequence
  Description of Artificial Sequence: Synthetic oligonucleotide
tgatctcggctcgct

SEQ ID NO: 806 - DNA, 15 bp, Artificial Sequence
  Description of Artificial Sequence: Synthetic oligonucleotide
tgttgctgtgtctgt

SEQ ID NO: 807 - DNA, 15 bp, Artificial Sequence
  Description of Artificial Sequence: Synthetic oligonucleotide
ccgggtctgtgtgga

SEQ ID NO: 808 - DNA, 15 bp, Artificial Sequence
  Description of Artificial Sequence: Synthetic oligonucleotide
ccggattgcagcctc

SEQ ID NO: 809 - DNA, 15 bp, Artificial Sequence
  Description of Artificial Sequence: Synthetic oligonucleotide
ttctctccactatta

SEQ ID NO: 810 - DNA, 15 bp, Artificial Sequence
  Description of Artificial Sequence: Synthetic oligonucleotide
ttgtatttttggtgg

SEQ ID NO: 811 - DNA, 15 bp, Artificial Sequence
  Description of Artificial Sequence: Synthetic oligonucleotide
cgatggcggttttgt

SEQ ID NO: 812 - DNA, 15 bp, Artificial Sequence
  Description of Artificial Sequence: Synthetic oligonucleotide
tgtgaccttaccccc

SEQ ID NO: 813 - DNA, 15 bp, Artificial Sequence
  Description of Artificial Sequence: Synthetic oligonucleotide
cctgtcccctctttc

SEQ ID NO: 814 - DNA, 15 bp, Artificial Sequence
  Description of Artificial Sequence: Synthetic oligonucleotide
cctctgttgccgagg

SEQ ID NO: 815 - DNA, 15 bp, Artificial Sequence
  Description of Artificial Sequence: Synthetic oligonucleotide
ttcacatgtttatct

SEQ ID NO: 816 - DNA, 15 bp, Artificial Sequence
  Description of Artificial Sequence: Synthetic oligonucleotide
ggaatagaaaggcgg

SEQ ID NO: 817 - DNA, 15 bp, Artificial Sequence
  Description of Artificial Sequence: Synthetic oligonucleotide
ttgggatgctgttga

SEQ ID NO: 818 - DNA, 15 bp, Artificial Sequence
  Description of Artificial Sequence: Synthetic oligonucleotide
attgcagcctctgcc

SEQ ID NO: 819 - DNA, 15 bp, Artificial Sequence
  Description of Artificial Sequence: Synthetic oligonucleotide
ggtcctctgcctagg

SEQ ID NO: 820 - DNA, 15 bp, Artificial Sequence
  Description of Artificial Sequence: Synthetic oligonucleotide
cggtctccctctcat

SEQ ID NO: 821 - DNA, 15 bp, Artificial Sequence
  Description of Artificial Sequence: Synthetic oligonucleotide
tgaccttctctccac

SEQ ID NO: 822 - DNA, 15 bp, Artificial Sequence
  Description of Artificial Sequence: Synthetic oligonucleotide
actgctgccatctcg

SEQ ID NO: 823 - DNA, 15 bp, Artificial Sequence
  Description of Artificial Sequence: Synthetic oligonucleotide
ggggaaaaaattgag

SEQ ID NO: 824 - DNA, 15 bp, Artificial Sequence
  Description of Artificial Sequence: Synthetic oligonucleotide
ggcctgccgagtgcc

SEQ ID NO: 825 - DNA, 15 bp, Artificial Sequence
  Description of Artificial Sequence: Synthetic oligonucleotide
ccagcctcggcctcc

SEQ ID NO: 826 - DNA, 15 bp, Artificial Sequence
  Description of Artificial Sequence: Synthetic oligonucleotide
attggggatgggcca

SEQ ID NO: 827 - DNA, 15 bp, Artificial Sequence
  Description of Artificial Sequence: Synthetic oligonucleotide
gttggccgggccggt

SEQ ID NO: 828 - DNA, 15 bp, Artificial Sequence
  Description of Artificial Sequence: Synthetic oligonucleotide
gtgctctctgaaaca

SEQ ID NO: 829 - DNA, 15 bp, Artificial Sequence
  Description of Artificial Sequence: Synthetic oligonucleotide
gattgcaggcacgcg

SEQ ID NO: 830 - DNA, 15 bp, Artificial Sequence
  Description of Artificial Sequence: Synthetic oligonucleotide
tcgctgtgttggccg

SEQ ID NO: 831 - DNA, 15 bp, Artificial Sequence
  Description of Artificial Sequence: Synthetic oligonucleotide
acgggccatgatgac

SEQ ID NO: 832 - DNA, 15 bp, Artificial Sequence
  Description of Artificial Sequence: Synthetic oligonucleotide
tatcaataaaaaaaa

SEQ ID NO: 833 - DNA, 15 bp, Artificial Sequence
  Description of Artificial Sequence: Synthetic oligonucleotide
ccatgatgacaatgg

SEQ ID NO: 834 - DNA, 15 bp, Artificial Sequence
  Description of Artificial Sequence: Synthetic oligonucleotide
tactgccgccatctc

SEQ ID NO: 835 - DNA, 15 bp, Artificial Sequence
  Description of Artificial Sequence: Synthetic oligonucleotide
cgcccagtctgggaa

SEQ ID NO: 836 - DNA, 15 bp, Artificial Sequence
  Description of Artificial Sequence: Synthetic oligonucleotide
tatctgctgaccttc

SEQ ID NO: 837 - DNA, 15 bp, Artificial Sequence
  Description of Artificial Sequence: Synthetic oligonucleotide
gccccttctgggaag

SEQ ID NO: 838 - DNA, 15 bp, Artificial Sequence
  Description of Artificial Sequence: Synthetic oligonucleotide
ctcattgagaacggg

SEQ ID NO: 839 - DNA, 15 bp, Artificial Sequence
  Description of Artificial Sequence: Synthetic oligonucleotide
tattgtcccatgacc

SEQ ID NO: 840 - DNA, 15 bp, Artificial Sequence
  Description of Artificial Sequence: Synthetic oligonucleotide
gccgggtctgtgtgg

SEQ ID NO: 841 - DNA, 15 bp, Artificial Sequence
  Description of Artificial Sequence: Synthetic oligonucleotide
agtgatctgcccgcc

SEQ ID NO: 842 - DNA, 15 bp, Artificial Sequence
  Description of Artificial Sequence: Synthetic oligonucleotide
gatggttgccgggtc

SEQ ID NO: 843 - DNA, 15 bp, Artificial Sequence
  Description of Artificial Sequence: Synthetic oligonucleotide
ttacccccaaccccg

SEQ ID NO: 844 - DNA, 15 bp, Artificial Sequence
  Description of Artificial Sequence: Synthetic oligonucleotide
cgccccgtccgggag

SEQ ID NO: 845 - DNA, 15 bp, Artificial Sequence
  Description of Artificial Sequence: Synthetic oligonucleotide
ccaccccgtctggga

SEQ ID NO: 846 - DNA, 15 bp, Artificial Sequence
  Description of Artificial Sequence: Synthetic oligonucleotide
tgggaggtggggggg

SEQ ID NO: 847 - DNA, 15 bp, Artificial Sequence
  Description of Artificial Sequence: Synthetic oligonucleotide
gtctccagctcctaa

SEQ ID NO: 848 - DNA, 15 bp, Artificial Sequence
  Description of Artificial Sequence: Synthetic oligonucleotide
aagattgcagcctct

SEQ ID NO: 849 - DNA, 15 bp, Artificial Sequence
  Description of Artificial Sequence: Synthetic oligonucleotide
gtgccgggattgcag

SEQ ID NO: 850 - DNA, 15 bp, Artificial Sequence
  Description of Artificial Sequence: Synthetic oligonucleotide
ataaccttaccccca

SEQ ID NO: 851 - DNA, 15 bp, Artificial Sequence
  Description of Artificial Sequence: Synthetic oligonucleotide
gttaagagtcatcac

SEQ ID NO: 852 - DNA, 15 bp, Artificial Sequence
  Description of Artificial Sequence: Synthetic oligonucleotide
gaagtgaggagcccc

SEQ ID NO: 853 - DNA, 15 bp, Artificial Sequence
  Description of Artificial Sequence: Synthetic oligonucleotide
gtgtctgtgtagaaa

SEQ ID NO: 854 - DNA, 15 bp, Artificial Sequence
  Description of Artificial Sequence: Synthetic oligonucleotide
ggggagcgcctctgc

SEQ ID NO: 855 - DNA, 15 bp, Artificial Sequence
  Description of Artificial Sequence: Synthetic oligonucleotide
ttgaccgggctggtc

SEQ ID NO: 856 - DNA, 15 bp, Artificial Sequence
  Description of Artificial Sequence: Synthetic oligonucleotide
ggtggggaaaaaatt

SEQ ID NO: 857 - DNA, 15 bp, Artificial Sequence
  Description of Artificial Sequence: Synthetic oligonucleotide
gtccgggaggtgggg

SEQ ID NO: 858 - DNA, 15 bp, Artificial Sequence
  Description of Artificial Sequence: Synthetic oligonucleotide
gggggcgcctctgcc

SEQ ID NO: 859 - DNA, 15 bp, Artificial Sequence
  Description of Artificial Sequence: Synthetic oligonucleotide
cgctacaacctccac

SEQ ID NO: 860 - DNA, 15 bp, Artificial Sequence
  Description of Artificial Sequence: Synthetic oligonucleotide
ggggaaaagatagag

SEQ ID NO: 861 - DNA, 15 bp, Artificial Sequence
  Description of Artificial Sequence: Synthetic oligonucleotide
aacacccaagaatga

SEQ ID NO: 862 - DNA, 15 bp, Artificial Sequence
  Description of Artificial Sequence: Synthetic oligonucleotide
ctgttaatctataac

SEQ ID NO: 863 - DNA, 15 bp, Artificial Sequence
  Description of Artificial Sequence: Synthetic oligonucleotide
tgtgttgaccgggct

SEQ ID NO: 864 - DNA, 15 bp, Artificial Sequence
  Description of Artificial Sequence: Synthetic oligonucleotide
accgcgagtgatctg

SEQ ID NO: 865 - DNA, 15 bp, Artificial Sequence
  Description of Artificial Sequence: Synthetic oligonucleotide
tgggggggtcagccc

SEQ ID NO: 866 - DNA, 15 bp, Artificial Sequence
  Description of Artificial Sequence: Synthetic oligonucleotide
tcccaaagtgctaag

SEQ ID NO: 867 - DNA, 15 bp, Artificial Sequence
  Description of Artificial Sequence: Synthetic oligonucleotide
ctcagggttaaatgg

SEQ ID NO: 868 - DNA, 15 bp, Artificial Sequence
  Description of Artificial Sequence: Synthetic oligonucleotide
tggccgggccggtct

SEQ ID NO: 869 - DNA, 15 bp, Artificial Sequence
  Description of Artificial Sequence: Synthetic oligonucleotide
tcctgcctcagcctg

SEQ ID NO: 870 - DNA, 15 bp, Artificial Sequence
  Description of Artificial Sequence: Synthetic oligonucleotide
gtctctgcctggccg

SEQ ID NO: 871 - DNA, 15 bp, Artificial Sequence
  Description of Artificial Sequence: Synthetic oligonucleotide
tcactgcaacctccc

SEQ ID NO: 872 - DNA, 15 bp, Artificial Sequence
  Description of Artificial Sequence: Synthetic oligonucleotide
ggagcccctctgcct

SEQ ID NO: 873 - DNA, 15 bp, Artificial Sequence
  Description of Artificial Sequence: Synthetic oligonucleotide
gtgatctgcccgcct

SEQ ID NO: 874 - DNA, 15 bp, Artificial Sequence
  Description of Artificial Sequence: Synthetic oligonucleotide
gcaagatgtgctttg

SEQ ID NO: 875 - DNA, 15 bp, Artificial Sequence
  Description of Artificial Sequence: Synthetic oligonucleotide
ggcgtgatctcggct

SEQ ID NO: 876 - DNA, 15 bp, Artificial Sequence
  Description of Artificial Sequence: Synthetic oligonucleotide
cctgattctcctgcc

SEQ ID NO: 877 - DNA, 15 bp, Artificial Sequence
  Description of Artificial Sequence: Synthetic oligonucleotide
gccaggatgacaatg

SEQ ID NO: 878 - DNA, 15 bp, Artificial Sequence
  Description of Artificial Sequence: Synthetic oligonucleotide
attgcaggcgcgcgc

SEQ ID NO: 879 - DNA, 15 bp, Artificial Sequence
  Description of Artificial Sequence: Synthetic oligonucleotide
tgcggagccgaagct

SEQ ID NO: 880 - DNA, 15 bp, Artificial Sequence
  Description of Artificial Sequence: Synthetic oligonucleotide
caacctccctgcctg

SEQ ID NO: 881 - DNA, 15 bp, Artificial Sequence
  Description of Artificial Sequence: Synthetic oligonucleotide
tgctgggattgcaga

SEQ ID NO: 882 - DNA, 15 bp, Artificial Sequence
  Description of Artificial Sequence: Synthetic oligonucleotide
caacctccctgcctc

SEQ ID NO: 883 - DNA, 15 bp, Artificial Sequence
  Description of Artificial Sequence: Synthetic oligonucleotide
acagctcattgagaa

SEQ ID NO: 884 - DNA, 15 bp, Artificial Sequence
  Description of Artificial Sequence: Synthetic oligonucleotide
cgccatcccatctag

SEQ ID NO: 885 - DNA, 15 bp, Artificial Sequence
  Description of Artificial Sequence: Synthetic oligonucleotide
ttcattttgttctgt

SEQ ID NO: 886 - DNA, 15 bp, Artificial Sequence
  Description of Artificial Sequence: Synthetic oligonucleotide
agcccctctgcctgg

SEQ ID NO: 887 - DNA, 15 bp, Artificial Sequence
  Description of Artificial Sequence: Synthetic oligonucleotide
tctccgagaaacacc

SEQ ID NO: 888 - DNA, 15 bp, Artificial Sequence
  Description of Artificial Sequence: Synthetic oligonucleotide
ggccgcagggtcctc

SEQ ID NO: 889 - DNA, 15 bp, Artificial Sequence
  Description of Artificial Sequence: Synthetic oligonucleotide
cgccccttctgggaa

SEQ ID NO: 890 - DNA, 15 bp, Artificial Sequence
  Description of Artificial Sequence: Synthetic oligonucleotide
ctcccctctttctac

SEQ ID NO: 891 - DNA, 15 bp, Artificial Sequence
  Description of Artificial Sequence: Synthetic oligonucleotide
caataaatactaaaa

SEQ ID NO: 892 - DNA, 15 bp, Artificial Sequence
  Description of Artificial Sequence: Synthetic oligonucleotide
atggcggttttgtgg

SEQ ID NO: 893 - DNA, 15 bp, Artificial Sequence
  Description of Artificial Sequence: Synthetic oligonucleotide
attgcaggcacgcgc

SEQ ID NO: 894 - DNA, 15 bp, Artificial Sequence
  Description of Artificial Sequence: Synthetic oligonucleotide
tcacgtgtttatctg

SEQ ID NO: 895 - DNA, 15 bp, Artificial Sequence
  Description of Artificial Sequence: Synthetic oligonucleotide
aagaggtagacatgg

SEQ ID NO: 896 - DNA, 15 bp, Artificial Sequence
  Description of Artificial Sequence: Synthetic oligonucleotide
ttaagtacccaggga

SEQ ID NO: 897 - DNA, 15 bp, Artificial Sequence
  Description of Artificial Sequence: Synthetic oligonucleotide
cgggctccagtgatt

SEQ ID NO: 898 - DNA, 15 bp, Artificial Sequence
  Description of Artificial Sequence: Synthetic oligonucleotide
gggatgtggggagcg

SEQ ID NO: 899 - DNA, 15 bp, Artificial Sequence
  Description of Artificial Sequence: Synthetic oligonucleotide
gggatgtggggagca

SEQ ID NO: 900 - DNA, 15 bp, Artificial Sequence
  Description of Artificial Sequence: Synthetic oligonucleotide
agacttcattttgtt

SEQ ID NO: 901 - DNA, 15 bp, Artificial Sequence
  Description of Artificial Sequence: Synthetic oligonucleotide
gtatttttttggtgg

SEQ ID NO: 902 - DNA, 15 bp, Artificial Sequence
  Description of Artificial Sequence: Synthetic oligonucleotide
atcgtctgggatgtg

SEQ ID NO: 903 - DNA, 15 bp, Artificial Sequence
  Description of Artificial Sequence: Synthetic oligonucleotide
gcgcctcttcccggc

SEQ ID NO: 904 - DNA, 15 bp, Artificial Sequence
  Description of Artificial Sequence: Synthetic oligonucleotide
acaaacactgcggaa

SEQ ID NO: 905 - DNA, 15 bp, Artificial Sequence
  Description of Artificial Sequence: Synthetic oligonucleotide
cccatcgtctgagat

SEQ ID NO: 906 - DNA, 15 bp, Artificial Sequence
  Description of Artificial Sequence: Synthetic oligonucleotide
gagacttcattttgt

SEQ ID NO: 907 - DNA, 15 bp, Artificial Sequence
  Description of Artificial Sequence: Synthetic oligonucleotide
ttaagagtcatcacc

SEQ ID NO: 908 - DNA, 15 bp, Artificial Sequence
  Description of Artificial Sequence: Synthetic oligonucleotide
gggcgcctctgcccg

SEQ ID NO: 909 - DNA, 15 bp, Artificial Sequence
  Description of Artificial Sequence: Synthetic oligonucleotide
ctcactgcaacctcc

SEQ ID NO: 910 - DNA, 15 bp, Artificial Sequence
  Description of Artificial Sequence: Synthetic oligonucleotide
atcgtctgagatgtg

SEQ ID NO: 911 - DNA, 15 bp, Artificial Sequence
  Description of Artificial Sequence: Synthetic oligonucleotide
ccggccgcccagtct

SEQ ID NO: 912 - DNA, 15 bp, Artificial Sequence
  Description of Artificial Sequence: Synthetic oligonucleotide
tgagatgtggggagc

SEQ ID NO: 913 - DNA, 15 bp, Artificial Sequence
  Description of Artificial Sequence: Synthetic oligonucleotide
gctgccatctcggct

SEQ ID NO: 914 - DNA, 15 bp, Artificial Sequence
  Description of Artificial Sequence: Synthetic oligonucleotide
agtggcgtgatctcg

SEQ ID NO: 915 - DNA, 15 bp, Artificial Sequence
  Description of Artificial Sequence: Synthetic oligonucleotide
cgcctgccttggcct

SEQ ID NO: 916 - DNA, 15 bp, Artificial Sequence
  Description of Artificial Sequence: Synthetic oligonucleotide
gctgtgtccactcag

SEQ ID NO: 917 - DNA, 15 bp, Artificial Sequence
  Description of Artificial Sequence: Synthetic oligonucleotide
ctcttcccggccgcc

SEQ ID NO: 918 - DNA, 15 bp, Artificial Sequence
  Description of Artificial Sequence: Synthetic oligonucleotide
gccgccacgcctgac

SEQ ID NO: 919 - DNA, 15 bp, Artificial Sequence
  Description of Artificial Sequence: Synthetic oligonucleotide
tttttttggtggaga

SEQ ID NO: 920 - DNA, 15 bp, Artificial Sequence
  Description of Artificial Sequence: Synthetic oligonucleotide
ctccctgtcccctct

SEQ ID NO: 921 - DNA, 15 bp, Artificial Sequence
  Description of Artificial Sequence: Synthetic oligonucleotide
ttacccccaaccctg

SEQ ID NO: 922 - DNA, 15 bp, Artificial Sequence
  Description of Artificial Sequence: Synthetic oligonucleotide
tgtggatagaagtag

SEQ ID NO: 923 - DNA, 15 bp, Artificial Sequence
  Description of Artificial Sequence: Synthetic oligonucleotide
ctacaaccacctccc

SEQ ID NO: 924 - DNA, 15 bp, Artificial Sequence
  Description of Artificial Sequence: Synthetic oligonucleotide
gtttatctgctgacc

SEQ ID NO: 925 - DNA, 15 bp, Artificial Sequence
  Description of Artificial Sequence: Synthetic oligonucleotide
ggggatgggccatga

SEQ ID NO: 926 - DNA, 15 bp, Artificial Sequence
  Description of Artificial Sequence: Synthetic oligonucleotide
gacttcattttgttc

SEQ ID NO: 927 - DNA, 15 bp, Artificial Sequence
  Description of Artificial Sequence: Synthetic oligonucleotide
tggcggttttgtgga

SEQ ID NO: 928 - DNA, 15 bp, Artificial Sequence
  Description of Artificial Sequence: Synthetic oligonucleotide
ccgcccagtctggga

SEQ ID NO: 929 - DNA, 15 bp, Artificial Sequence
  Description of Artificial Sequence: Synthetic oligonucleotide
ctcccagccgcctgc

SEQ ID NO: 930 - DNA, 15 bp, Artificial Sequence
  Description of Artificial Sequence: Synthetic oligonucleotide
gctcgctacaaccac

SEQ ID NO: 931 - DNA, 15 bp, Artificial Sequence
  Description of Artificial Sequence: Synthetic oligonucleotide
caccccgtctgggaa

SEQ ID NO: 932 - DNA, 15 bp, Artificial Sequence
  Description of Artificial Sequence: Synthetic oligonucleotide
gggagcgcctctgcc

SEQ ID NO: 933 - DNA, 15 bp, Artificial Sequence
  Description of Artificial Sequence: Synthetic oligonucleotide
gtggaatagaaaggc

SEQ ID NO: 934 - DNA, 15 bp, Artificial Sequence
  Description of Artificial Sequence: Synthetic oligonucleotide
tctcggctcactgca

SEQ ID NO: 935 - DNA, 15 bp, Artificial Sequence
  Description of Artificial Sequence: Synthetic oligonucleotide
gtggaatagaaaggg

SEQ ID NO: 936 - DNA, 15 bp, Artificial Sequence
  Description of Artificial Sequence: Synthetic oligonucleotide
gggaggaggtggggg

SEQ ID NO: 937 - DNA, 15 bp, Artificial Sequence
  Description of Artificial Sequence: Synthetic oligonucleotide
tttgtatttttggtg

SEQ ID NO: 938 - DNA, 15 bp, Artificial Sequence
  Description of Artificial Sequence: Synthetic oligonucleotide
ggtgcccaggctgga

SEQ ID NO: 939 - DNA, 15 bp, Artificial Sequence
  Description of Artificial Sequence: Synthetic oligonucleotide
tatttttttggtgga

SEQ ID NO: 940 - DNA, 15 bp, Artificial Sequence
  Description of Artificial Sequence: Synthetic oligonucleotide
ccgcctcggcctccc

SEQ ID NO: 941 - DNA, 15 bp, Artificial Sequence
  Description of Artificial Sequence: Synthetic oligonucleotide
tgccgggtctgtgtg

SEQ ID NO: 942 - DNA, 15 bp, Artificial Sequence
  Description of Artificial Sequence: Synthetic oligonucleotide
gaatagaaagggggg

SEQ ID NO: 943 - DNA, 15 bp, Artificial Sequence
  Description of Artificial Sequence: Synthetic oligonucleotide
tcaagtacccaggga

SEQ ID NO: 944 - DNA, 15 bp, Artificial Sequence
  Description of Artificial Sequence: Synthetic oligonucleotide
ggtagacatgggaga

SEQ ID NO: 945 - DNA, 15 bp, Artificial Sequence
  Description of Artificial Sequence: Synthetic oligonucleotide
acatgtgctgtgtcc

SEQ ID NO: 946 - DNA, 15 bp, Artificial Sequence
  Description of Artificial Sequence: Synthetic oligonucleotide
acatgtgctgtgtca

SEQ ID NO: 947 - DNA, 15 bp, Artificial Sequence
  Description of Artificial Sequence: Synthetic oligonucleotide
cggagtctggttcac

SEQ ID NO: 948 - DNA, 15 bp, Artificial Sequence
  Description of Artificial Sequence: Synthetic oligonucleotide
cgtatttttttggtg

SEQ ID NO: 949 - DNA, 15 bp, Artificial Sequence
  Description of Artificial Sequence: Synthetic oligonucleotide
acccccaaccccgtg

SEQ ID NO: 950 - DNA, 15 bp, Artificial Sequence
  Description of Artificial Sequence: Synthetic oligonucleotide
cctgcctgattctcc

SEQ ID NO: 951 - DNA, 15 bp, Artificial Sequence
  Description of Artificial Sequence: Synthetic oligonucleotide
cgtctgggaggtgtg

SEQ ID NO: 952 - DNA, 15 bp, Artificial Sequence
  Description of Artificial Sequence: Synthetic oligonucleotide
cgtctgggaggtgta

SEQ ID NO: 953 - DNA, 15 bp, Artificial Sequence
  Description of Artificial Sequence: Synthetic oligonucleotide
tctgcgagaaacacc

SEQ ID NO: 954 - DNA, 15 bp, Artificial Sequence
  Description of Artificial Sequence: Synthetic oligonucleotide
ttgagaacgggccat

SEQ ID NO: 955 - DNA, 15 bp, Artificial Sequence
  Description of Artificial Sequence: Synthetic oligonucleotide
ccccctctgcgagaa

SEQ ID NO: 956 - DNA, 15 bp, Artificial Sequence
  Description of Artificial Sequence: Synthetic oligonucleotide
cattggggatgggcc

SEQ ID NO: 957 - DNA, 15 bp, Artificial Sequence
  Description of Artificial Sequence: Synthetic oligonucleotide
gcgggaagggtgggg

SEQ ID NO: 958 - DNA, 15 bp, Artificial Sequence
  Description of Artificial Sequence: Synthetic oligonucleotide
gtacccagggacaca

SEQ ID NO: 959 - DNA, 15 bp, Artificial Sequence
  Description of Artificial Sequence: Synthetic oligonucleotide
gcgcctctgccccgc

SEQ ID NO: 960 - DNA, 15 bp, Artificial Sequence
  Description of Artificial Sequence: Synthetic oligonucleotide
tttcgccgtgttggc

SEQ ID NO: 961 - DNA, 15 bp, Artificial Sequence
  Description of Artificial Sequence: Synthetic oligonucleotide
tgtactgccgtgatc

SEQ ID NO: 962 - DNA, 15 bp, Artificial Sequence
  Description of Artificial Sequence: Synthetic oligonucleotide
acctccctgcctcgg

SEQ ID NO: 963 - DNA, 15 bp, Artificial Sequence
  Description of Artificial Sequence: Synthetic oligonucleotide
attttttggtggaga

SEQ ID NO: 964 - DNA, 15 bp, Artificial Sequence
  Description of Artificial Sequence: Synthetic oligonucleotide
ctatgaccctgccac

SEQ ID NO: 965 - DNA, 15 bp, Artificial Sequence
  Description of Artificial Sequence: Synthetic oligonucleotide
cttgtttatctgctg

SEQ ID NO: 966 - DNA, 15 bp, Artificial Sequence
  Description of Artificial Sequence: Synthetic oligonucleotide
ctatgaccctgccaa

SEQ ID NO: 967 - DNA, 15 bp, Artificial Sequence
  Description of Artificial Sequence: Synthetic oligonucleotide
taaaaaaaaaaaaaa

SEQ ID NO: 968 - DNA, 15 bp, Artificial Sequence
  Description of Artificial Sequence: Synthetic oligonucleotide
cgctacaacctacac

SEQ ID NO: 969 - DNA, 15 bp, Artificial Sequence
  Description of Artificial Sequence: Synthetic oligonucleotide
gtccactcagggtta

SEQ ID NO: 970 - DNA, 15 bp, Artificial Sequence
  Description of Artificial Sequence: Synthetic oligonucleotide
gcagggtcctctgcc

SEQ ID NO: 971 - DNA, 15 bp, Artificial Sequence
  Description of Artificial Sequence: Synthetic oligonucleotide
cccctctttccacgg

SEQ ID NO: 972 - DNA, 15 bp, Artificial Sequence
  Description of Artificial Sequence: Synthetic oligonucleotide
gtctgggaggtgagg

SEQ ID NO: 973 - DNA, 15 bp, Artificial Sequence
  Description of Artificial Sequence: Synthetic oligonucleotide
tggggatgggccatg

SEQ ID NO: 974 - DNA, 15 bp, Artificial Sequence
  Description of Artificial Sequence: Synthetic oligonucleotide
ggtgtacccagcgac

SEQ ID NO: 975 - DNA, 15 bp, Artificial Sequence
  Description of Artificial Sequence: Synthetic oligonucleotide
gctgaccttccctcc

SEQ ID NO: 976 - DNA, 15 bp, Artificial Sequence
  Description of Artificial Sequence: Synthetic oligonucleotide
ccgcgagtgatctgc

SEQ ID NO: 977 - DNA, 15 bp, Artificial Sequence
  Description of Artificial Sequence: Synthetic oligonucleotide
cggccgccccttctg

SEQ ID NO: 978 - DNA, 15 bp, Artificial Sequence
  Description of Artificial Sequence: Synthetic oligonucleotide
gattgagaaatcgga

SEQ ID NO: 979 - DNA, 15 bp, Artificial Sequence
  Description of Artificial Sequence: Synthetic oligonucleotide
agtgcctgggattgc

SEQ ID NO: 980 - DNA, 15 bp, Artificial Sequence
  Description of Artificial Sequence: Synthetic oligonucleotide
ctgagatgtggggag

SEQ ID NO: 981 - DNA, 15 bp, Artificial Sequence
  Description of Artificial Sequence: Synthetic oligonucleotide
agaagtagacatggg

SEQ ID NO: 982 - DNA, 15 bp, Artificial Sequence
  Description of Artificial Sequence: Synthetic oligonucleotide
cgcccatcgtctggg

SEQ ID NO: 983 - DNA, 15 bp, Artificial Sequence
  Description of Artificial Sequence: Synthetic oligonucleotide
tgcccggccgcccag

SEQ ID NO: 984 - DNA, 15 bp, Artificial Sequence
  Description of Artificial Sequence: Synthetic oligonucleotide
tcaataaaaaaaaaa

SEQ ID NO: 985 - DNA, 15 bp, Artificial Sequence
  Description of Artificial Sequence: Synthetic oligonucleotide
gtcgaatagaaaagg

SEQ ID NO: 986 - DNA, 15 bp, Artificial Sequence
  Description of Artificial Sequence: Synthetic oligonucleotide
ctccctctcccctct

SEQ ID NO: 987 - DNA, 15 bp, Artificial Sequence
  Description of Artificial Sequence: Synthetic oligonucleotide
tgcccggccgcccat

SEQ ID NO: 988 - DNA, 15 bp, Artificial Sequence
  Description of Artificial Sequence: Synthetic oligonucleotide
ttgagaacgggccag

SEQ ID NO: 989 - DNA, 15 bp, Artificial Sequence
  Description of Artificial Sequence: Synthetic oligonucleotide
agctggacggtactg

SEQ ID NO: 990 - DNA, 15 bp, Artificial Sequence
  Description of Artificial Sequence: Synthetic oligonucleotide
tgtatttttggtgga

SEQ ID NO: 991 - DNA, 15 bp, Artificial Sequence
  Description of Artificial Sequence: Synthetic oligonucleotide
aagaatgatcaataa

SEQ ID NO: 992 - DNA, 15 bp, Artificial Sequence
  Description of Artificial Sequence: Synthetic oligonucleotide
ctaatctcaagtaat

SEQ ID NO: 993 - DNA, 15 bp, Artificial Sequence
  Description of Artificial Sequence: Synthetic oligonucleotide
gatcctgttgatctg

SEQ ID NO: 994 - DNA, 15 bp, Artificial Sequence
  Description of Artificial Sequence: Synthetic oligonucleotide
tcggctcgctgcaac

SEQ ID NO: 995 - DNA, 15 bp, Artificial Sequence
  Description of Artificial Sequence: Synthetic oligonucleotide
cgccatctcggctca

SEQ ID NO: 996 - DNA, 15 bp, Artificial Sequence
  Description of Artificial Sequence: Synthetic oligonucleotide
aagaagtagacatag

SEQ ID NO: 997 - DNA, 15 bp, Artificial Sequence
  Description of Artificial Sequence: Synthetic oligonucleotide
ctccagctcctggcc

SEQ ID NO: 998 - DNA, 15 bp, Artificial Sequence
  Description of Artificial Sequence: Synthetic oligonucleotide
aaaagggggaaatgt

SEQ ID NO: 999 - DNA, 15 bp, Artificial Sequence
  Description of Artificial Sequence: Synthetic oligonucleotide
actgcggaaggccgc

SEQ ID NO: 1000 - DNA, 15 bp, Artificial Sequence
  Description of Artificial Sequence: Synthetic oligonucleotide
ccgtgatctcggctc

SEQ ID NO: 1001 - DNA, 15 bp, Artificial Sequence
  Description of Artificial Sequence: Synthetic oligonucleotide
tgtgtccactcaggg

SEQ ID NO: 1002 - DNA, 15 bp, Artificial Sequence
  Description of Artificial Sequence: Synthetic oligonucleotide
cgtgtttatctgctg

SEQ ID NO: 1003 - DNA, 15 bp, Artificial Sequence
  Description of Artificial Sequence: Synthetic oligonucleotide
atttttggtggagac

SEQ ID NO: 1004 - DNA, 15 bp, Artificial Sequence
  Description of Artificial Sequence: Synthetic oligonucleotide
agacctttgttcaca

SEQ ID NO: 1005 - DNA, 15 bp, Artificial Sequence
  Description of Artificial Sequence: Synthetic oligonucleotide
agacctttgttcacg

SEQ ID NO: 1006 - DNA, 15 bp, Artificial Sequence
  Description of Artificial Sequence: Synthetic oligonucleotide
ggattgcagacggag

SEQ ID NO: 1007 - DNA, 15 bp, Artificial Sequence
  Description of Artificial Sequence: Synthetic oligonucleotide
cccaaccccgtgctc

SEQ ID NO: 1008 - DNA, 15 bp, Artificial Sequence
  Description of Artificial Sequence: Synthetic oligonucleotide
agctcctggcctcga

SEQ ID NO: 1009 - DNA, 15 bp, Artificial Sequence
  Description of Artificial Sequence: Synthetic oligonucleotide
tagaaagaagtagac

SEQ ID NO: 1010 - DNA, 15 bp, Artificial Sequence
  Description of Artificial Sequence: Synthetic oligonucleotide
ctccagtgattctcc

SEQ ID NO: 1011 - DNA, 15 bp, Artificial Sequence
  Description of Artificial Sequence: Synthetic oligonucleotide
ctgcccggccaccgc

SEQ ID NO: 1012 - DNA, 15 bp, Artificial Sequence
  Description of Artificial Sequence: Synthetic oligonucleotide
atctcaagtaatcag

SEQ ID NO: 1013 - DNA, 15 bp, Artificial Sequence
  Description of Artificial Sequence: Synthetic oligonucleotide
gatggcggttttgtc

SEQ ID NO: 1014 - DNA, 15 bp, Artificial Sequence
  Description of Artificial Sequence: Synthetic oligonucleotide
gatggcggttttgtg

SEQ ID NO: 1015 - DNA, 15 bp, Artificial Sequence
  Description of Artificial Sequence: Synthetic oligonucleotide
aagtacccagggaca

SEQ ID NO: 1016 - DNA, 15 bp, Artificial Sequence
  Description of Artificial Sequence: Synthetic oligonucleotide
tcctggcctcgagtg

SEQ ID NO: 1017 - DNA, 15 bp, Artificial Sequence
  Description of Artificial Sequence: Synthetic oligonucleotide
cgttaagagtcatca

SEQ ID NO: 1018 - DNA, 15 bp, Artificial Sequence
  Description of Artificial Sequence: Synthetic oligonucleotide
acaatggcggctttg

SEQ ID NO: 1019 - DNA, 15 bp, Artificial Sequence
  Description of Artificial Sequence: Synthetic oligonucleotide
ggatgctgttgatct

SEQ ID NO: 1020 - DNA, 15 bp, Artificial Sequence
  Description of Artificial Sequence: Synthetic oligonucleotide
gtgtagaaagaggta

SEQ ID NO: 1021 - DNA, 15 bp, Artificial Sequence
  Description of Artificial Sequence: Synthetic oligonucleotide
aagattgagaaatcg

SEQ ID NO: 1022 - DNA, 15 bp, Artificial Sequence
  Description of Artificial Sequence: Synthetic oligonucleotide
gtgctgggattgcag

SEQ ID NO: 1023 - DNA, 15 bp, Artificial Sequence
  Description of Artificial Sequence: Synthetic oligonucleotide
ctccactattatcct

SEQ ID NO: 1024 - DNA, 15 bp, Artificial Sequence
  Description of Artificial Sequence: Synthetic oligonucleotide
gaccgcgagtgatct

SEQ ID NO: 1025 - DNA, 15 bp, Artificial Sequence
  Description of Artificial Sequence: Synthetic oligonucleotide
ggccatgatgacgat

SEQ ID NO: 1026 - DNA, 15 bp, Artificial Sequence
  Description of Artificial Sequence: Synthetic oligonucleotide
ccccgcccggccagc

SEQ ID NO: 1027 - DNA, 15 bp, Artificial Sequence
  Description of Artificial Sequence: Synthetic oligonucleotide
cggtctccagcccct

SEQ ID NO: 1028 - DNA, 15 bp, Artificial Sequence
  Description of Artificial Sequence: Synthetic oligonucleotide
cgtccgggaggaggt

SEQ ID NO: 1029 - DNA, 15 bp, Artificial Sequence
  Description of Artificial Sequence: Synthetic oligonucleotide
tacaacctacacctc

SEQ ID NO: 1030 - DNA, 15 bp, Artificial Sequence
  Description of Artificial Sequence: Synthetic oligonucleotide
gggagacttcatttt

SEQ ID NO: 1031 - DNA, 15 bp, Artificial Sequence
  Description of Artificial Sequence: Synthetic oligonucleotide
ccgggaggtgggggg

SEQ ID NO: 1032 - DNA, 15 bp, Artificial Sequence
  Description of Artificial Sequence: Synthetic oligonucleotide
ggttttgtggaatag

SEQ ID NO: 1033 - DNA, 15 bp, Artificial Sequence
  Description of Artificial Sequence: Synthetic oligonucleotide
gtttttttttggtgg

SEQ ID NO: 1034 - DNA, 15 bp, Artificial Sequence
  Description of Artificial Sequence: Synthetic oligonucleotide
cgggctggtctccag

SEQ ID NO: 1035 - DNA, 15 bp, Artificial Sequence
  Description of Artificial Sequence: Synthetic oligonucleotide
tccactattgtccta

SEQ ID NO: 1036 - DNA, 15 bp, Artificial Sequence
  Description of Artificial Sequence: Synthetic oligonucleotide
attgagaacgggcca

SEQ ID NO: 1037 - DNA, 15 bp, Artificial Sequence
  Description of Artificial Sequence: Synthetic oligonucleotide
cttctctccactatt

SEQ ID NO: 1038 - DNA, 15 bp, Artificial Sequence
  Description of Artificial Sequence: Synthetic oligonucleotide
gtgatccgccagcct

SEQ ID NO: 1039 - DNA, 15 bp, Artificial Sequence
  Description of Artificial Sequence: Synthetic oligonucleotide
gctggacggtactgc

SEQ ID NO: 1040 - DNA, 15 bp, Artificial Sequence
  Description of Artificial Sequence: Synthetic oligonucleotide
cccgtccgggaggag

SEQ ID NO: 1041 - DNA, 15 bp, Artificial Sequence
  Description of Artificial Sequence: Synthetic oligonucleotide
tctgggatgtgggga

SEQ ID NO: 1042 - DNA, 15 bp, Artificial Sequence
  Description of Artificial Sequence: Synthetic oligonucleotide
agagacctttgttca

SEQ ID NO: 1043 - DNA, 15 bp, Artificial Sequence
  Description of Artificial Sequence: Synthetic oligonucleotide
ccctctgcccggccg

SEQ ID NO: 1044 - DNA, 15 bp, Artificial Sequence
  Description of Artificial Sequence: Synthetic oligonucleotide
gacctttgttcactt

SEQ ID NO: 1045 - DNA, 15 bp, Artificial Sequence
  Description of Artificial Sequence: Synthetic oligonucleotide
ccctctgcccggcca

SEQ ID NO: 1046 - DNA, 15 bp, Artificial Sequence
  Description of Artificial Sequence: Synthetic oligonucleotide
tgccccgccgccccg

SEQ ID NO: 1047 - DNA, 15 bp, Artificial Sequence
  Description of Artificial Sequence: Synthetic oligonucleotide
ccggccgccccgtct

SEQ ID NO: 1048 - DNA, 15 bp, Artificial Sequence
  Description of Artificial Sequence: Synthetic oligonucleotide
gattgttactgtgtc

SEQ ID NO: 1049 - DNA, 15 bp, Artificial Sequence
  Description of Artificial Sequence: Synthetic oligonucleotide
tgggatgtggggagc

SEQ ID NO: 1050 - DNA, 15 bp, Artificial Sequence
  Description of Artificial Sequence: Synthetic oligonucleotide
acctccacctcccag

SEQ ID NO: 1051 - DNA, 15 bp, Artificial Sequence
  Description of Artificial Sequence: Synthetic oligonucleotide
tggttttcgtttttt

SEQ ID NO: 1052 - DNA, 15 bp, Artificial Sequence
  Description of Artificial Sequence: Synthetic oligonucleotide
ccggccaccgccccg

SEQ ID NO: 1053 - DNA, 15 bp, Artificial Sequence
  Description of Artificial Sequence: Synthetic oligonucleotide
aatgatcaataaaaa

SEQ ID NO: 1054 - DNA, 15 bp, Artificial Sequence
  Description of Artificial Sequence: Synthetic oligonucleotide
accccgtgctctctg

SEQ ID NO: 1055 - DNA, 15 bp, Artificial Sequence
  Description of Artificial Sequence: Synthetic oligonucleotide
gagtctcgttcactc

SEQ ID NO: 1056 - DNA, 15 bp, Artificial Sequence
  Description of Artificial Sequence: Synthetic oligonucleotide
cacgtgtttatctgc

SEQ ID NO: 1057 - DNA, 15 bp, Artificial Sequence
  Description of Artificial Sequence: Synthetic oligonucleotide
caggcacgcgccgcc

SEQ ID NO: 1058 - DNA, 15 bp, Artificial Sequence
  Description of Artificial Sequence: Synthetic oligonucleotide
tagacatgggagact

SEQ ID NO: 1059 - DNA, 15 bp, Artificial Sequence
  Description of Artificial Sequence: Synthetic oligonucleotide
ttaatctataacctt

SEQ ID NO: 1060 - DNA, 15 bp, Artificial Sequence
  Description of Artificial Sequence: Synthetic oligonucleotide
tctccactattatcc

SEQ ID NO: 1061 - DNA, 15 bp, Artificial Sequence
  Description of Artificial Sequence: Synthetic oligonucleotide
gtgtacccaacagct

SEQ ID NO: 1062 - DNA, 15 bp, Artificial Sequence
  Description of Artificial Sequence: Synthetic oligonucleotide
ccagctcctggcctc

SEQ ID NO: 1063 - DNA, 15 bp, Artificial Sequence
  Description of Artificial Sequence: Synthetic oligonucleotide
ccgtccgggaggtgg

SEQ ID NO: 1064 - DNA, 15 bp, Artificial Sequence
  Description of Artificial Sequence: Synthetic oligonucleotide
ccgtccgggaggtga

SEQ ID NO: 1065 - DNA, 15 bp, Artificial Sequence
  Description of Artificial Sequence: Synthetic oligonucleotide
ccatctcggctcact

SEQ ID NO: 1066 - DNA, 15 bp, Artificial Sequence
  Description of Artificial Sequence: Synthetic oligonucleotide
ccccccgcccggcca

SEQ ID NO: 1067 - DNA, 15 bp, Artificial Sequence
  Description of Artificial Sequence: Synthetic oligonucleotide
ttgtcctatgaccct

SEQ ID NO: 1068 - DNA, 15 bp, Artificial Sequence
  Description of Artificial Sequence: Synthetic oligonucleotide
cggtctccctctgat

SEQ ID NO: 1069 - DNA, 15 bp, Artificial Sequence
  Description of Artificial Sequence: Synthetic oligonucleotide
attctcctgcctcgg

SEQ ID NO: 1070 - DNA, 15 bp, Artificial Sequence
  Description of Artificial Sequence: Synthetic oligonucleotide
gatctgtgaccttac

SEQ ID NO: 1071 - DNA, 15 bp, Artificial Sequence
  Description of Artificial Sequence: Synthetic oligonucleotide
tgcccggccaccgcc

SEQ ID NO: 1072 - DNA, 15 bp, Artificial Sequence
  Description of Artificial Sequence: Synthetic oligonucleotide
actaagaaaaattct

SEQ ID NO: 1073 - DNA, 15 bp, Artificial Sequence
  Description of Artificial Sequence: Synthetic oligonucleotide
aagtgctaagattgc

SEQ ID NO: 1074 - DNA, 15 bp, Artificial Sequence
  Description of Artificial Sequence: Synthetic oligonucleotide
gagcgtctctgcccg

SEQ ID NO: 1075 - DNA, 15 bp, Artificial Sequence
  Description of Artificial Sequence: Synthetic oligonucleotide
gatctgtgaccttat

SEQ ID NO: 1076 - DNA, 15 bp, Artificial Sequence
  Description of Artificial Sequence: Synthetic oligonucleotide
tggttcactcagtgc

SEQ ID NO: 1077 - DNA, 15 bp, Artificial Sequence
  Description of Artificial Sequence: Synthetic oligonucleotide
gaccctgccaaatcc

SEQ ID NO: 1078 - DNA, 15 bp, Artificial Sequence
  Description of Artificial Sequence: Synthetic oligonucleotide
gattgcagcctctgc

SEQ ID NO: 1079 - DNA, 15 bp, Artificial Sequence
  Description of Artificial Sequence: Synthetic oligonucleotide
gacctctgcctagga

SEQ ID NO: 1080 - DNA, 15 bp, Artificial Sequence
  Description of Artificial Sequence: Synthetic oligonucleotide
catgatgacgatggc

SEQ ID NO: 1081 - DNA, 15 bp, Artificial Sequence
  Description of Artificial Sequence: Synthetic oligonucleotide
gggattgcagacgga

SEQ ID NO: 1082 - DNA, 15 bp, Artificial Sequence
  Description of Artificial Sequence: Synthetic oligonucleotide
cgggaggaggtgggg

SEQ ID NO: 1083 - DNA, 15 bp, Artificial Sequence
  Description of Artificial Sequence: Synthetic oligonucleotide
accccgtctgggagg

SEQ ID NO: 1084 - DNA, 15 bp, Artificial Sequence
  Description of Artificial Sequence: Synthetic oligonucleotide
ctccctctccctctc

SEQ ID NO: 1085 - DNA, 15 bp, Artificial Sequence
  Description of Artificial Sequence: Synthetic oligonucleotide
ctctccacggtctcc

SEQ ID NO: 1086 - DNA, 15 bp, Artificial Sequence
  Description of Artificial Sequence: Synthetic oligonucleotide
ggagtctcgctcact

SEQ ID NO: 1087 - DNA, 15 bp, Artificial Sequence
  Description of Artificial Sequence: Synthetic oligonucleotide
ggcctcgagtgatct

SEQ ID NO: 1088 - DNA, 15 bp, Artificial Sequence
  Description of Artificial Sequence: Synthetic oligonucleotide
cctctgcctggctgc

SEQ ID NO: 1089 - DNA, 15 bp, Artificial Sequence
  Description of Artificial Sequence: Synthetic oligonucleotide
tgcccggccgcccct

SEQ ID NO: 1090 - DNA, 15 bp, Artificial Sequence
  Description of Artificial Sequence: Synthetic oligonucleotide
atgccgagccgaagc

SEQ ID NO: 1091 - DNA, 15 bp, Artificial Sequence
  Description of Artificial Sequence: Synthetic oligonucleotide
aaatccccctctgtg

SEQ ID NO: 1092 - DNA, 15 bp, Artificial Sequence
  Description of Artificial Sequence: Synthetic oligonucleotide
cctttgttcacttgt

SEQ ID NO: 1093 - DNA, 15 bp, Artificial Sequence
  Description of Artificial Sequence: Synthetic oligonucleotide
ttgtttatctgctga

SEQ ID NO: 1094 - DNA, 15 bp, Artificial Sequence
  Description of Artificial Sequence: Synthetic oligonucleotide
actgtactgccgcca

SEQ ID NO: 1095 - DNA, 15 bp, Artificial Sequence
  Description of Artificial Sequence: Synthetic oligonucleotide
aaaaaaaaaaaaaaa

SEQ ID NO: 1096 - DNA, 15 bp, Artificial Sequence
  Description of Artificial Sequence: Synthetic oligonucleotide
gccgccatcccatct

SEQ ID NO: 1097 - DNA, 15 bp, Artificial Sequence
  Description of Artificial Sequence: Synthetic oligonucleotide
tgcccggccgccccg

SEQ ID NO: 1098 - DNA, 15 bp, Artificial Sequence
  Description of Artificial Sequence: Synthetic oligonucleotide
gacctttgttcacgt

SEQ ID NO: 1099 - DNA, 15 bp, Artificial Sequence
  Description of Artificial Sequence: Synthetic oligonucleotide
gccacatccccctct

SEQ ID NO: 1100 - DNA, 15 bp, Artificial Sequence
  Description of Artificial Sequence: Synthetic oligonucleotide
gttttcgtttttttt

SEQ ID NO: 1101 - DNA, 15 bp, Artificial Sequence
  Description of Artificial Sequence: Synthetic oligonucleotide
gtctctgcccggccg

SEQ ID NO: 1102 - DNA, 15 bp, Artificial Sequence
  Description of Artificial Sequence: Synthetic oligonucleotide
tggtctccagctcct

SEQ ID NO: 1103 - DNA, 15 bp, Artificial Sequence
  Description of Artificial Sequence: Synthetic oligonucleotide
cagacggagtctggt

SEQ ID NO: 1104 - DNA, 15 bp, Artificial Sequence
  Description of Artificial Sequence: Synthetic oligonucleotide
ccaaagagccggatt

SEQ ID NO: 1105 - DNA, 15 bp, Artificial Sequence
  Description of Artificial Sequence: Synthetic oligonucleotide
tggctgcccagtctg

SEQ ID NO: 1106 - DNA, 15 bp, Artificial Sequence
  Description of Artificial Sequence: Synthetic oligonucleotide
gagatcagattgtta

SEQ ID NO: 1107 - DNA, 15 bp, Artificial Sequence
  Description of Artificial Sequence: Synthetic oligonucleotide
gggaaatgtggggaa

SEQ ID NO: 1108 - DNA, 15 bp, Artificial Sequence
  Description of Artificial Sequence: Synthetic oligonucleotide
cctcccaaagtgcta

SEQ ID NO: 1109 - DNA, 15 bp, Artificial Sequence
  Description of Artificial Sequence: Synthetic oligonucleotide
ccatcgtctgagatg

SEQ ID NO: 1110 - DNA, 15 bp, Artificial Sequence
  Description of Artificial Sequence: Synthetic oligonucleotide
ggccgcccatcgtct

SEQ ID NO: 1111 - DNA, 15 bp, Artificial Sequence
  Description of Artificial Sequence: Synthetic oligonucleotide
ggagtgcagtggcgt

SEQ ID NO: 1112 - DNA, 15 bp, Artificial Sequence
  Description of Artificial Sequence: Synthetic oligonucleotide
ccctaaccgcgagtg

SEQ ID NO: 1113 - DNA, 15 bp, Artificial Sequence
  Description of Artificial Sequence: Synthetic oligonucleotide
ggttttgtcgaaaag

SEQ ID NO: 1114 - DNA, 15 bp, Artificial Sequence
  Description of Artificial Sequence: Synthetic oligonucleotide
taatctataacctta

SEQ ID NO: 1115 - DNA, 15 bp, Artificial Sequence
  Description of Artificial Sequence: Synthetic oligonucleotide
tacacctcccagccg

SEQ ID NO: 1116 - DNA, 15 bp, Artificial Sequence
  Description of Artificial Sequence: Synthetic oligonucleotide
ttgcagcctctgccc

SEQ ID NO: 1117 - DNA, 15 bp, Artificial Sequence
  Description of Artificial Sequence: Synthetic oligonucleotide
agattgagaaatcgg

SEQ ID NO: 1118 - DNA, 15 bp, Artificial Sequence
  Description of Artificial Sequence: Synthetic oligonucleotide
attgttactgtgtct

SEQ ID NO: 1119 - DNA, 15 bp, Artificial Sequence
  Description of Artificial Sequence: Synthetic oligonucleotide
tttgttcacttgttt

SEQ ID NO: 1120 - DNA, 15 bp, Artificial Sequence
  Description of Artificial Sequence: Synthetic oligonucleotide
ctcgctacaacctac

SEQ ID NO: 1121 - DNA, 15 bp, Artificial Sequence
  Description of Artificial Sequence: Synthetic oligonucleotide
actggttttcgtttt

SEQ ID NO: 1122 - DNA, 15 bp, Artificial Sequence
  Description of Artificial Sequence: Synthetic oligonucleotide
ctgcccggccaccac

SEQ ID NO: 1123 - DNA, 15 bp, Artificial Sequence
  Description of Artificial Sequence: Synthetic oligonucleotide
gctccagtgattctc

SEQ ID NO: 1124 - DNA, 15 bp, Artificial Sequence
  Description of Artificial Sequence: Synthetic oligonucleotide
ctaagaaaaattctt

SEQ ID NO: 1125 - DNA, 15 bp, Artificial Sequence
  Description of Artificial Sequence: Synthetic oligonucleotide
ccccctctccgagaa

SEQ ID NO: 1126 - DNA, 15 bp, Artificial Sequence
  Description of Artificial Sequence: Synthetic oligonucleotide
cctctctccacggtc

SEQ ID NO: 1127 - DNA, 15 bp, Artificial Sequence
  Description of Artificial Sequence: Synthetic oligonucleotide
aatagaaagggggga

SEQ ID NO: 1128 - DNA, 15 bp, Artificial Sequence
  Description of Artificial Sequence: Synthetic oligonucleotide
tctttccacggtctc

SEQ ID NO: 1129 - DNA, 15 bp, Artificial Sequence
  Description of Artificial Sequence: Synthetic oligonucleotide
cgtgtctgtgtagaa

SEQ ID NO: 1130 - DNA, 15 bp, Artificial Sequence
  Description of Artificial Sequence: Synthetic oligonucleotide
tccagctcctaaccg

SEQ ID NO: 1131 - DNA, 15 bp, Artificial Sequence
  Description of Artificial Sequence: Synthetic oligonucleotide
tcctaaccgcgagtg

SEQ ID NO: 1132 - DNA, 15 bp, Artificial Sequence
  Description of Artificial Sequence: Synthetic oligonucleotide
tgaccttccctccac

SEQ ID NO: 1133 - DNA, 15 bp, Artificial Sequence
  Description of Artificial Sequence: Synthetic oligonucleotide
cagggacctctgcct

SEQ ID NO: 1134 - DNA, 15 bp, Artificial Sequence
  Description of Artificial Sequence: Synthetic oligonucleotide
tgttaaacagatgct

SEQ ID NO: 1135 - DNA, 15 bp, Artificial Sequence
  Description of Artificial Sequence: Synthetic oligonucleotide
ccgtctgggaggtga

SEQ ID NO: 1136 - DNA, 15 bp, Artificial Sequence
  Description of Artificial Sequence: Synthetic oligonucleotide
aatgatcaataaata

SEQ ID NO: 1137 - DNA, 15 bp, Artificial Sequence
  Description of Artificial Sequence: Synthetic oligonucleotide
cgccagcctcggcct

SEQ ID NO: 1138 - DNA, 15 bp, Artificial Sequence
  Description of Artificial Sequence: Synthetic oligonucleotide
tggtgcccaggctgg

SEQ ID NO: 1139 - DNA, 15 bp, Artificial Sequence
  Description of Artificial Sequence: Synthetic oligonucleotide
tgcctggccgcccat

SEQ ID NO: 1140 - DNA, 15 bp, Artificial Sequence
  Description of Artificial Sequence: Synthetic oligonucleotide
aggaaaaccagagac

SEQ ID NO: 1141 - DNA, 15 bp, Artificial Sequence
  Description of Artificial Sequence: Synthetic oligonucleotide
ctcggctcgctgcaa

SEQ ID NO: 1142 - DNA, 15 bp, Artificial Sequence
  Description of Artificial Sequence: Synthetic oligonucleotide
gaggtgtgcccaaca

SEQ ID NO: 1143 - DNA, 15 bp, Artificial Sequence
  Description of Artificial Sequence: Synthetic oligonucleotide
acgcgccgccacgcc

SEQ ID NO: 1144 - DNA, 15 bp, Artificial Sequence
  Description of Artificial Sequence: Synthetic oligonucleotide
ccgtctgggaggtgt

SEQ ID NO: 1145 - DNA, 15 bp, Artificial Sequence
  Description of Artificial Sequence: Synthetic oligonucleotide
ctcctggcctcgagt

SEQ ID NO: 1146 - DNA, 15 bp, Artificial Sequence
  Description of Artificial Sequence: Synthetic oligonucleotide
gagtctggttcactc

SEQ ID NO: 1147 - DNA, 15 bp, Artificial Sequence
  Description of Artificial Sequence: Synthetic oligonucleotide
cgtctctgcccggcc

SEQ ID NO: 1148 - DNA, 15 bp, Artificial Sequence
  Description of Artificial Sequence: Synthetic oligonucleotide
ttctcctgcctcagc

SEQ ID NO: 1149 - DNA, 15 bp, Artificial Sequence
  Description of Artificial Sequence: Synthetic oligonucleotide
ccctgtgctctctga

SEQ ID NO: 1150 - DNA, 15 bp, Artificial Sequence
  Description of Artificial Sequence: Synthetic oligonucleotide
cctcccgaggtgctg

SEQ ID NO: 1151 - DNA, 15 bp, Artificial Sequence
  Description of Artificial Sequence: Synthetic oligonucleotide
gtcccatgaccctgc

SEQ ID NO: 1152 - DNA, 15 bp, Artificial Sequence
  Description of Artificial Sequence: Synthetic oligonucleotide
agaaagagagatcag

SEQ ID NO: 1153 - DNA, 15 bp, Artificial Sequence
  Description of Artificial Sequence: Synthetic oligonucleotide
cgagccgaggctgga

SEQ ID NO: 1154 - DNA, 15 bp, Artificial Sequence
  Description of Artificial Sequence: Synthetic oligonucleotide
atagaaaggcgggaa

SEQ ID NO: 1155 - DNA, 15 bp, Artificial Sequence
  Description of Artificial Sequence: Synthetic oligonucleotide
agccgccccgtccgg

SEQ ID NO: 1156 - DNA, 15 bp, Artificial Sequence
  Description of Artificial Sequence: Synthetic oligonucleotide
cggattgcagcctct

SEQ ID NO: 1157 - DNA, 15 bp, Artificial Sequence
  Description of Artificial Sequence: Synthetic oligonucleotide
ttatccccaaccctg

SEQ ID NO: 1158 - DNA, 15 bp, Artificial Sequence
  Description of Artificial Sequence: Synthetic oligonucleotide
aatctataaccttac

SEQ ID NO: 1159 - DNA, 15 bp, Artificial Sequence
  Description of Artificial Sequence: Synthetic oligonucleotide
ctacaacctccacct

SEQ ID NO: 1160 - DNA, 15 bp, Artificial Sequence
  Description of Artificial Sequence: Synthetic oligonucleotide
gtggggagcacctct

SEQ ID NO: 1161 - DNA, 15 bp, Artificial Sequence
  Description of Artificial Sequence: Synthetic oligonucleotide
aaatccccctctgcg

SEQ ID NO: 1162 - DNA, 15 bp, Artificial Sequence
  Description of Artificial Sequence: Synthetic oligonucleotide
tgcaggcgcgcgccg

SEQ ID NO: 1163 - DNA, 15 bp, Artificial Sequence
  Description of Artificial Sequence: Synthetic oligonucleotide
gatctcggctcgctg

SEQ ID NO: 1164 - DNA, 15 bp, Artificial Sequence
  Description of Artificial Sequence: Synthetic oligonucleotide
cagcctgccgagtgc

SEQ ID NO: 1165 - DNA, 15 bp, Artificial Sequence
  Description of Artificial Sequence: Synthetic oligonucleotide
agattgcagcctctg

SEQ ID NO: 1166 - DNA, 15 bp, Artificial Sequence
  Description of Artificial Sequence: Synthetic oligonucleotide
tgcccagcggctcat

SEQ ID NO: 1167 - DNA, 15 bp, Artificial Sequence
  Description of Artificial Sequence: Synthetic oligonucleotide
aggtgaggggcgcct

SEQ ID NO: 1168 - DNA, 15 bp, Artificial Sequence
  Description of Artificial Sequence: Synthetic oligonucleotide
gatctcggctcgcta

SEQ ID NO: 1169 - DNA, 15 bp, Artificial Sequence
  Description of Artificial Sequence: Synthetic oligonucleotide
tgcccgcctcggcct

SEQ ID NO: 1170 - DNA, 15 bp, Artificial Sequence
  Description of Artificial Sequence: Synthetic oligonucleotide
gggcggtgcaagatg

SEQ ID NO: 1171 - DNA, 15 bp, Artificial Sequence
  Description of Artificial Sequence: Synthetic oligonucleotide
cccgtctaggaagtg

SEQ ID NO: 1172 - DNA, 15 bp, Artificial Sequence
  Description of Artificial Sequence: Synthetic oligonucleotide
agacataggagactc

SEQ ID NO: 1173 - DNA, 15 bp, Artificial Sequence
  Description of Artificial Sequence: Synthetic oligonucleotide
taatcttaagtaccc

SEQ ID NO: 1174 - DNA, 15 bp, Artificial Sequence
  Description of Artificial Sequence: Synthetic oligonucleotide
acctccctgcctgat

SEQ ID NO: 1175 - DNA, 15 bp, Artificial Sequence
  Description of Artificial Sequence: Synthetic oligonucleotide
tccgccagcctcggc

SEQ ID NO: 1176 - DNA, 15 bp, Artificial Sequence
  Description of Artificial Sequence: Synthetic oligonucleotide
tcccgtctgggaagt

SEQ ID NO: 1177 - DNA, 15 bp, Artificial Sequence
  Description of Artificial Sequence: Synthetic oligonucleotide
gaggtgccgggattg

SEQ ID NO: 1178 - DNA, 15 bp, Artificial Sequence
  Description of Artificial Sequence: Synthetic oligonucleotide
cctctgcgagaaaca

SEQ ID NO: 1179 - DNA, 15 bp, Artificial Sequence
  Description of Artificial Sequence: Synthetic oligonucleotide
tggttttcgtatttt

SEQ ID NO: 1180 - DNA, 15 bp, Artificial Sequence
  Description of Artificial Sequence: Synthetic oligonucleotide
cccctaaccgcgagt

SEQ ID NO: 1181 - DNA, 15 bp, Artificial Sequence
  Description of Artificial Sequence: Synthetic oligonucleotide
agatgtgctttgtta

SEQ ID NO: 1182 - DNA, 15 bp, Artificial Sequence
  Description of Artificial Sequence: Synthetic oligonucleotide
aaaaaattgagaaat

SEQ ID NO: 1183 - DNA, 15 bp, Artificial Sequence
  Description of Artificial Sequence: Synthetic oligonucleotide
atgcggagccgaagc

SEQ ID NO: 1184 - DNA, 15 bp, Artificial Sequence
  Description of Artificial Sequence: Synthetic oligonucleotide
gctgtgttgaccggg

SEQ ID NO: 1185 - DNA, 15 bp, Artificial Sequence
  Description of Artificial Sequence: Synthetic oligonucleotide
tttcgctgtgttgac

SEQ ID NO: 1186 - DNA, 15 bp, Artificial Sequence
  Description of Artificial Sequence: Synthetic oligonucleotide
gctgggattgcagac

SEQ ID NO: 1187 - DNA, 15 bp, Artificial Sequence
  Description of Artificial Sequence: Synthetic oligonucleotide
gatgccgagccgagg

SEQ ID NO: 1188 - DNA, 15 bp, Artificial Sequence
  Description of Artificial Sequence: Synthetic oligonucleotide
cgtgatctcggctcg

SEQ ID NO: 1189 - DNA, 15 bp, Artificial Sequence
  Description of Artificial Sequence: Synthetic oligonucleotide
tgtgaccttatcccc

SEQ ID NO: 1190 - DNA, 15 bp, Artificial Sequence
  Description of Artificial Sequence: Synthetic oligonucleotide
aatgttgcccaggct

SEQ ID NO: 1191 - DNA, 15 bp, Artificial Sequence
  Description of Artificial Sequence: Synthetic oligonucleotide
ctttccacggtctcc

SEQ ID NO: 1192 - DNA, 15 bp, Artificial Sequence
  Description of Artificial Sequence: Synthetic oligonucleotide
agtgcctgcgattgc

SEQ ID NO: 1193 - DNA, 15 bp, Artificial Sequence
  Description of Artificial Sequence: Synthetic oligonucleotide
ccggtctccagcccc

SEQ ID NO: 1194 - DNA, 15 bp, Artificial Sequence
  Description of Artificial Sequence: Synthetic oligonucleotide
agaacgggccaggat

SEQ ID NO: 1195 - DNA, 15 bp, Artificial Sequence
  Description of Artificial Sequence: Synthetic oligonucleotide
aggctggagtgcagt

SEQ ID NO: 1196 - DNA, 15 bp, Artificial Sequence
  Description of Artificial Sequence: Synthetic oligonucleotide
gccgagccgaagctg

SEQ ID NO: 1197 - DNA, 15 bp, Artificial Sequence
  Description of Artificial Sequence: Synthetic oligonucleotide
gtgtagaaagaagta

SEQ ID NO: 1198 - DNA, 15 bp, Artificial Sequence
  Description of Artificial Sequence: Synthetic oligonucleotide
tttcattttgttctg

SEQ ID NO: 1199 - DNA, 15 bp, Artificial Sequence
  Description of Artificial Sequence: Synthetic oligonucleotide
agagccggattgcag

SEQ ID NO: 1200 - DNA, 15 bp, Artificial Sequence
  Description of Artificial Sequence: Synthetic oligonucleotide
gggatgggccatgat

SEQ ID NO: 1201 - DNA, 15 bp, Artificial Sequence
  Description of Artificial Sequence: Synthetic oligonucleotide
gcggctttgtggaat

SEQ ID NO: 1202 - DNA, 15 bp, Artificial Sequence
  Description of Artificial Sequence: Synthetic oligonucleotide
tgaggagcccctctg

SEQ ID NO: 1203 - DNA, 15 bp, Artificial Sequence
  Description of Artificial Sequence: Synthetic oligonucleotide
aaatcggattgttgc

SEQ ID NO: 1204 - DNA, 15 bp, Artificial Sequence
  Description of Artificial Sequence: Synthetic oligonucleotide
ttatcaataaaaaaa

SEQ ID NO: 1205 - DNA, 15 bp, Artificial Sequence
  Description of Artificial Sequence: Synthetic oligonucleotide
acacccaagaattat

SEQ ID NO: 1206 - DNA, 15 bp, Artificial Sequence
  Description of Artificial Sequence: Synthetic oligonucleotide
cacctcccagccgcc

SEQ ID NO: 1207 - DNA, 15 bp, Artificial Sequence
  Description of Artificial Sequence: Synthetic oligonucleotide
ggcctcccaaagtgc

SEQ ID NO: 1208 - DNA, 15 bp, Artificial Sequence
  Description of Artificial Sequence: Synthetic oligonucleotide
tgtgcccaacagctc

SEQ ID NO: 1209 - DNA, 15 bp, Artificial Sequence
  Description of Artificial Sequence: Synthetic oligonucleotide
gcccggccgccccgt

SEQ ID NO: 1210 - DNA, 15 bp, Artificial Sequence
  Description of Artificial Sequence: Synthetic oligonucleotide
ctcaagtacccaggg

SEQ ID NO: 1211 - DNA, 15 bp, Artificial Sequence
  Description of Artificial Sequence: Synthetic oligonucleotide
cagggtcctctgcct

SEQ ID NO: 1212 - DNA, 15 bp, Artificial Sequence
  Description of Artificial Sequence: Synthetic oligonucleotide
catcccatctaggaa

SEQ ID NO: 1213 - DNA, 15 bp, Artificial Sequence
  Description of Artificial Sequence: Synthetic oligonucleotide
ttggcctcccaaagt

SEQ ID NO: 1214 - DNA, 15 bp, Artificial Sequence
  Description of Artificial Sequence: Synthetic oligonucleotide
tgatgacgatggcgg

SEQ ID NO: 1215 - DNA, 15 bp, Artificial Sequence
  Description of Artificial Sequence: Synthetic oligonucleotide
ggtgccgggattgca

SEQ ID NO: 1216 - DNA, 15 bp, Artificial Sequence
  Description of Artificial Sequence: Synthetic oligonucleotide
atgctgttgatctgt

SEQ ID NO: 1217 - DNA, 15 bp, Artificial Sequence
  Description of Artificial Sequence: Synthetic oligonucleotide
caatggtgcccaggc

SEQ ID NO: 1218 - DNA, 15 bp, Artificial Sequence
  Description of Artificial Sequence: Synthetic oligonucleotide
gggattgcaggcgcg

SEQ ID NO: 1219 - DNA, 15 bp, Artificial Sequence
  Description of Artificial Sequence: Synthetic oligonucleotide
tccagcccctaaccg

SEQ ID NO: 1220 - DNA, 15 bp, Artificial Sequence
  Description of Artificial Sequence: Synthetic oligonucleotide
ttggcctcccaaaga

SEQ ID NO: 1221 - DNA, 15 bp, Artificial Sequence
  Description of Artificial Sequence: Synthetic oligonucleotide
cggtgcaagatgtgc

SEQ ID NO: 1222 - DNA, 15 bp, Artificial Sequence
  Description of Artificial Sequence: Synthetic oligonucleotide
gctgtgtcaactcag

SEQ ID NO: 1223 - DNA, 15 bp, Artificial Sequence
  Description of Artificial Sequence: Synthetic oligonucleotide
ccgcccggccgccat

SEQ ID NO: 1224 - DNA, 15 bp, Artificial Sequence
  Description of Artificial Sequence: Synthetic oligonucleotide
cctctttccacggtc

SEQ ID NO: 1225 - DNA, 15 bp, Artificial Sequence
  Description of Artificial Sequence: Synthetic oligonucleotide
gttttgtggaataga

SEQ ID NO: 1226 - DNA, 15 bp, Artificial Sequence
  Description of Artificial Sequence: Synthetic oligonucleotide
aaatcggatggttgc

SEQ ID NO: 1227 - DNA, 15 bp, Artificial Sequence
  Description of Artificial Sequence: Synthetic oligonucleotide
gctcgctgcaacctc

SEQ ID NO: 1228 - DNA, 15 bp, Artificial Sequence
  Description of Artificial Sequence: Synthetic oligonucleotide
gctcgttaagagtca

SEQ ID NO: 1229 - DNA, 15 bp, Artificial Sequence
  Description of Artificial Sequence: Synthetic oligonucleotide
acccaagaattatca

SEQ ID NO: 1230 - DNA, 15 bp, Artificial Sequence
  Description of Artificial Sequence: Synthetic oligonucleotide
aggctggactgtact

SEQ ID NO: 1231 - DNA, 15 bp, Artificial Sequence
  Description of Artificial Sequence: Synthetic oligonucleotide
ggccaccgccccgtc

SEQ ID NO: 1232 - DNA, 15 bp, Artificial Sequence
  Description of Artificial Sequence: Synthetic oligonucleotide
cggatggttgccgtg

SEQ ID NO: 1233 - DNA, 15 bp, Artificial Sequence
  Description of Artificial Sequence: Synthetic oligonucleotide
tacccagggacacaa

SEQ ID NO: 1234 - DNA, 15 bp, Artificial Sequence
  Description of Artificial Sequence: Synthetic oligonucleotide
gaccttccctccact

SEQ ID NO: 1235 - DNA, 15 bp, Artificial Sequence
  Description of Artificial Sequence: Synthetic oligonucleotide
aaccctgtgctctct

SEQ ID NO: 1236 - DNA, 15 bp, Artificial Sequence
  Description of Artificial Sequence: Synthetic oligonucleotide
ctgccacatccccct

SEQ ID NO: 1237 - DNA, 15 bp, Artificial Sequence
  Description of Artificial Sequence: Synthetic oligonucleotide
gttgcccaggctgga

SEQ ID NO: 1238 - DNA, 15 bp, Artificial Sequence
  Description of Artificial Sequence: Synthetic oligonucleotide
gttctgtactaagaa

SEQ ID NO: 1239 - DNA, 15 bp, Artificial Sequence
  Description of Artificial Sequence: Synthetic oligonucleotide
ttgtcgaaaagaaaa

SEQ ID NO: 1240 - DNA, 15 bp, Artificial Sequence
  Description of Artificial Sequence: Synthetic oligonucleotide
tccccctctgcgaga

SEQ ID NO: 1241 - DNA, 15 bp, Artificial Sequence
  Description of Artificial Sequence: Synthetic oligonucleotide
cctgcctcagcctgc

SEQ ID NO: 1242 - DNA, 15 bp, Artificial Sequence
  Description of Artificial Sequence: Synthetic oligonucleotide
ttactgtgtctgtgt

SEQ ID NO: 1243 - DNA, 15 bp, Artificial Sequence
  Description of Artificial Sequence: Synthetic oligonucleotide
tgggaggtgaggggc

SEQ ID NO: 1244 - DNA, 15 bp, Artificial Sequence
  Description of Artificial Sequence: Synthetic oligonucleotide
cttctgccttgggat

SEQ ID NO: 1245 - DNA, 15 bp, Artificial Sequence
  Description of Artificial Sequence: Synthetic oligonucleotide
gaccttacccccaac

SEQ ID NO: 1246 - DNA, 15 bp, Artificial Sequence
  Description of Artificial Sequence: Synthetic oligonucleotide
ttctcctgcctcggc

SEQ ID NO: 1247 - DNA, 15 bp, Artificial Sequence
  Description of Artificial Sequence: Synthetic oligonucleotide
ccgcagggtcctctg

SEQ ID NO: 1248 - DNA, 15 bp, Artificial Sequence
  Description of Artificial Sequence: Synthetic oligonucleotide
aggtgccgggattgc

SEQ ID NO: 1249 - DNA, 15 bp, Artificial Sequence
  Description of Artificial Sequence: Synthetic oligonucleotide
cccggccaccacccc

SEQ ID NO: 1250 - DNA, 15 bp, Artificial Sequence
  Description of Artificial Sequence: Synthetic oligonucleotide
catgggagacttcat

SEQ ID NO: 1251 - DNA, 15 bp, Artificial Sequence
  Description of Artificial Sequence: Synthetic oligonucleotide
tgcctggctgcccag

SEQ ID NO: 1252 - DNA, 15 bp, Artificial Sequence
  Description of Artificial Sequence: Synthetic oligonucleotide
tattatcctatgacc

SEQ ID NO: 1253 - DNA, 15 bp, Artificial Sequence
  Description of Artificial Sequence: Synthetic oligonucleotide
cctgcctcgggctcc

SEQ ID NO: 1254 - DNA, 15 bp, Artificial Sequence
  Description of Artificial Sequence: Synthetic oligonucleotide
gggggaaaggtgggg

SEQ ID NO: 1255 - DNA, 15 bp, Artificial Sequence
  Description of Artificial Sequence: Synthetic oligonucleotide
ctccctgcctcgggc

SEQ ID NO: 1256 - DNA, 15 bp, Artificial Sequence
  Description of Artificial Sequence: Synthetic oligonucleotide
cagcccctaaccgcg

SEQ ID NO: 1257 - DNA, 15 bp, Artificial Sequence
  Description of Artificial Sequence: Synthetic oligonucleotide
acctacacctcccag

SEQ ID NO: 1258 - DNA, 15 bp, Artificial Sequence
  Description of Artificial Sequence: Synthetic oligonucleotide
aaggtggggaaaaga

SEQ ID NO: 1259 - DNA, 15 bp, Artificial Sequence
  Description of Artificial Sequence: Synthetic oligonucleotide
tcccctctctccacg

SEQ ID NO: 1260 - DNA, 15 bp, Artificial Sequence
  Description of Artificial Sequence: Synthetic oligonucleotide
gatgtggggagcgcc

SEQ ID NO: 1261 - DNA, 15 bp, Artificial Sequence
  Description of Artificial Sequence: Synthetic oligonucleotide
gaccctgccacatcc

SEQ ID NO: 1262 - DNA, 15 bp, Artificial Sequence
  Description of Artificial Sequence: Synthetic oligonucleotide
agcggctcattgggg

SEQ ID NO: 1263 - DNA, 15 bp, Artificial Sequence
  Description of Artificial Sequence: Synthetic oligonucleotide
atcaataaaaaaaat

SEQ ID NO: 1264 - DNA, 15 bp, Artificial Sequence
  Description of Artificial Sequence: Synthetic oligonucleotide
gccttggcctcccaa

SEQ ID NO: 1265 - DNA, 15 bp, Artificial Sequence
  Description of Artificial Sequence: Synthetic oligonucleotide
ttaagggcggtgcaa

SEQ ID NO: 1266 - DNA, 15 bp, Artificial Sequence
  Description of Artificial Sequence: Synthetic oligonucleotide
atggcggctttgtgg

SEQ ID NO: 1267 - DNA, 15 bp, Artificial Sequence
  Description of Artificial Sequence: Synthetic oligonucleotide
aagggcggtgcaaga

SEQ ID NO: 1268 - DNA, 15 bp, Artificial Sequence
  Description of Artificial Sequence: Synthetic oligonucleotide
gtgccgagattgcag

SEQ ID NO: 1269 - DNA, 15 bp, Artificial Sequence
  Description of Artificial Sequence: Synthetic oligonucleotide
gcctgccttggcctc

SEQ ID NO: 1270 - DNA, 15 bp, Artificial Sequence
  Description of Artificial Sequence: Synthetic oligonucleotide
gccgccccgtccggg

SEQ ID NO: 1271 - DNA, 15 bp, Artificial Sequence
  Description of Artificial Sequence: Synthetic oligonucleotide
ccaaatccccctctc

SEQ ID NO: 1272 - DNA, 15 bp, Artificial Sequence
  Description of Artificial Sequence: Synthetic oligonucleotide
acctttgttcacatg

SEQ ID NO: 1273 - DNA, 15 bp, Artificial Sequence
  Description of Artificial Sequence: Synthetic oligonucleotide
ccaaatccccctctg

SEQ ID NO: 1274 - DNA, 15 bp, Artificial Sequence
  Description of Artificial Sequence: Synthetic oligonucleotide
tatcctatgaccctg

SEQ ID NO: 1275 - DNA, 15 bp, Artificial Sequence
  Description of Artificial Sequence: Synthetic oligonucleotide
ctgtgttgaccgggc

SEQ ID NO: 1276 - DNA, 15 bp, Artificial Sequence
  Description of Artificial Sequence: Synthetic oligonucleotide
gttttgtcgaataga

SEQ ID NO: 1277 - DNA, 15 bp, Artificial Sequence
  Description of Artificial Sequence: Synthetic oligonucleotide
ggtctccctctcatg

SEQ ID NO: 1278 - DNA, 15 bp, Artificial Sequence
  Description of Artificial Sequence: Synthetic oligonucleotide
gctaagattgcagcc

SEQ ID NO: 1279 - DNA, 15 bp, Artificial Sequence
  Description of Artificial Sequence: Synthetic oligonucleotide
ttaaatggattaagg

SEQ ID NO: 1280 - DNA, 15 bp, Artificial Sequence
  Description of Artificial Sequence: Synthetic oligonucleotide
tctggttcactcagt

SEQ ID NO: 1281 - DNA, 15 bp, Artificial Sequence
  Description of Artificial Sequence: Synthetic oligonucleotide
tgcccggccgccatc

SEQ ID NO: 1282 - DNA, 15 bp, Artificial Sequence
  Description of Artificial Sequence: Synthetic oligonucleotide
cgcccggccagccgc

SEQ ID NO: 1283 - DNA, 15 bp, Artificial Sequence
  Description of Artificial Sequence: Synthetic oligonucleotide
cccttctgggaagtg

SEQ ID NO: 1284 - DNA, 15 bp, Artificial Sequence
  Description of Artificial Sequence: Synthetic oligonucleotide
tccagctcctgaccg

SEQ ID NO: 1285 - DNA, 15 bp, Artificial Sequence
  Description of Artificial Sequence: Synthetic oligonucleotide
tggggagcgcctctg

SEQ ID NO: 1286 - DNA, 15 bp, Artificial Sequence
  Description of Artificial Sequence: Synthetic oligonucleotide
tcgagtgatctgccc

SEQ ID NO: 1287 - DNA, 15 bp, Artificial Sequence
  Description of Artificial Sequence: Synthetic oligonucleotide
gtccgggaggtgagg

SEQ ID NO: 1288 - DNA, 15 bp, Artificial Sequence
  Description of Artificial Sequence: Synthetic oligonucleotide
gcgattgcaggcgcg

SEQ ID NO: 1289 - DNA, 15 bp, Artificial Sequence
  Description of Artificial Sequence: Synthetic oligonucleotide
ttaaacagatgcttg

SEQ ID NO: 1290 - DNA, 15 bp, Artificial Sequence
  Description of Artificial Sequence: Synthetic oligonucleotide
tgttgcccaggctgg

SEQ ID NO: 1291 - DNA, 15 bp, Artificial Sequence
  Description of Artificial Sequence: Synthetic oligonucleotide
tcccgtctaggaagt

SEQ ID NO: 1292 - DNA, 15 bp, Artificial Sequence
  Description of Artificial Sequence: Synthetic oligonucleotide
ggtctccctctgatg

SEQ ID NO: 1293 - DNA, 15 bp, Artificial Sequence
  Description of Artificial Sequence: Synthetic oligonucleotide
ctgggattgcaggca

SEQ ID NO: 1294 - DNA, 15 bp, Artificial Sequence
  Description of Artificial Sequence: Synthetic oligonucleotide
ccaaagctggacggt

SEQ ID NO: 1295 - DNA, 15 bp, Artificial Sequence
  Description of Artificial Sequence: Synthetic oligonucleotide
tgactggttttcgtt

SEQ ID NO: 1296 - DNA, 15 bp, Artificial Sequence
  Description of Artificial Sequence: Synthetic oligonucleotide
aatccccctctgtga

SEQ ID NO: 1297 - DNA, 15 bp, Artificial Sequence
  Description of Artificial Sequence: Synthetic oligonucleotide
ttttttttggtggag

SEQ ID NO: 1298 - DNA, 15 bp, Artificial Sequence
  Description of Artificial Sequence: Synthetic oligonucleotide
tgttaatctataacc

SEQ ID NO: 1299 - DNA, 15 bp, Artificial Sequence
  Description of Artificial Sequence: Synthetic oligonucleotide
acccagggacacaaa

SEQ ID NO: 1300 - DNA, 15 bp, Artificial Sequence
  Description of Artificial Sequence: Synthetic oligonucleotide
cggcctgccgagtgc

SEQ ID NO: 1301 - DNA, 15 bp, Artificial Sequence
  Description of Artificial Sequence: Synthetic oligonucleotide
tattttttggtggag

SEQ ID NO: 1302 - DNA, 15 bp, Artificial Sequence
  Description of Artificial Sequence: Synthetic oligonucleotide
gcccctactgggaag

SEQ ID NO: 1303 - DNA, 15 bp, Artificial Sequence
  Description of Artificial Sequence: Synthetic oligonucleotide
cgtctgagatgtggg

SEQ ID NO: 1304 - DNA, 15 bp, Artificial Sequence
  Description of Artificial Sequence: Synthetic oligonucleotide
tgactggttttcgta

SEQ ID NO: 1305 - DNA, 15 bp, Artificial Sequence
  Description of Artificial Sequence: Synthetic oligonucleotide
gtgcctgggattgca

SEQ ID NO: 1306 - DNA, 15 bp, Artificial Sequence
  Description of Artificial Sequence: Synthetic oligonucleotide
tacccaacagctcat

SEQ ID NO: 1307 - DNA, 15 bp, Artificial Sequence
  Description of Artificial Sequence: Synthetic oligonucleotide
cgaaaagaaaagggg

SEQ ID NO: 1308 - DNA, 15 bp, Artificial Sequence
  Description of Artificial Sequence: Synthetic oligonucleotide
ggctggactgtactg

SEQ ID NO: 1309 - DNA, 15 bp, Artificial Sequence
  Description of Artificial Sequence: Synthetic oligonucleotide
ccaacagctcattga

SEQ ID NO: 1310 - DNA, 15 bp, Artificial Sequence
  Description of Artificial Sequence: Synthetic oligonucleotide
gggatcctgttgatc

SEQ ID NO: 1311 - DNA, 15 bp, Artificial Sequence
  Description of Artificial Sequence: Synthetic oligonucleotide
aaagggggaaatgtg

SEQ ID NO: 1312 - DNA, 15 bp, Artificial Sequence
  Description of Artificial Sequence: Synthetic oligonucleotide
ctgtactgccgtgat

SEQ ID NO: 1313 - DNA, 15 bp, Artificial Sequence
  Description of Artificial Sequence: Synthetic oligonucleotide
aggtgtacccaacag

SEQ ID NO: 1314 - DNA, 15 bp, Artificial Sequence
  Description of Artificial Sequence: Synthetic oligonucleotide
cccgtccgggaggtg

SEQ ID NO: 1315 - DNA, 15 bp, Artificial Sequence
  Description of Artificial Sequence: Synthetic oligonucleotide
tctcggctcgctgca

SEQ ID NO: 1316 - DNA, 15 bp, Artificial Sequence
  Description of Artificial Sequence: Synthetic oligonucleotide
aatcttaagtaccca

SEQ ID NO: 1317 - DNA, 15 bp, Artificial Sequence
  Description of Artificial Sequence: Synthetic oligonucleotide
cctcggcctcccgag

SEQ ID NO: 1318 - DNA, 15 bp, Artificial Sequence
  Description of Artificial Sequence: Synthetic oligonucleotide
agacctttgttcact

SEQ ID NO: 1319 - DNA, 15 bp, Artificial Sequence
  Description of Artificial Sequence: Synthetic oligonucleotide
atgatcaataaaaaa

SEQ ID NO: 1320 - DNA, 15 bp, Artificial Sequence
  Description of Artificial Sequence: Synthetic oligonucleotide
gccatcccgtctagg

SEQ ID NO: 1321 - DNA, 15 bp, Artificial Sequence
  Description of Artificial Sequence: Synthetic oligonucleotide
atttttttggtggag

SEQ ID NO: 1322 - DNA, 15 bp, Artificial Sequence
  Description of Artificial Sequence: Synthetic oligonucleotide
agaaaagggggaaat

SEQ ID NO: 1323 - DNA, 15 bp, Artificial Sequence
  Description of Artificial Sequence: Synthetic oligonucleotide
ttttcgttttttttt

SEQ ID NO: 1324 - DNA, 15 bp, Artificial Sequence
  Description of Artificial Sequence: Synthetic oligonucleotide
atgtggggagcgcct

SEQ ID NO: 1325 - DNA, 15 bp, Artificial Sequence
  Description of Artificial Sequence: Synthetic oligonucleotide
tctcaagtaatcagg

SEQ ID NO: 1326 - DNA, 15 bp, Artificial Sequence
  Description of Artificial Sequence: Synthetic oligonucleotide
gatcaataaatacta

SEQ ID NO: 1327 - DNA, 15 bp, Artificial Sequence
  Description of Artificial Sequence: Synthetic oligonucleotide
tctgctgaccttccc

SEQ ID NO: 1328 - DNA, 15 bp, Artificial Sequence
  Description of Artificial Sequence: Synthetic oligonucleotide
actgccgtgatctcg

SEQ ID NO: 1329 - DNA, 15 bp, Artificial Sequence
  Description of Artificial Sequence: Synthetic oligonucleotide
agctcattgagaacg

SEQ ID NO: 1330 - DNA, 15 bp, Artificial Sequence
  Description of Artificial Sequence: Synthetic oligonucleotide
atgtgaggagcgcct

SEQ ID NO: 1331 - DNA, 15 bp, Artificial Sequence
  Description of Artificial Sequence: Synthetic oligonucleotide
tactgtgtctgtgta

SEQ ID NO: 1332 - DNA, 15 bp, Artificial Sequence
  Description of Artificial Sequence: Synthetic oligonucleotide
gggaggtgtacccaa

SEQ ID NO: 1333 - DNA, 15 bp, Artificial Sequence
  Description of Artificial Sequence: Synthetic oligonucleotide
ggggggaaaggtggg

SEQ ID NO: 1334 - DNA, 15 bp, Artificial Sequence
  Description of Artificial Sequence: Synthetic oligonucleotide
gcctcgagtgatctg

SEQ ID NO: 1335 - DNA, 15 bp, Artificial Sequence
  Description of Artificial Sequence: Synthetic oligonucleotide
tctttctacggtctc

SEQ ID NO: 1336 - DNA, 15 bp, Artificial Sequence
  Description of Artificial Sequence: Synthetic oligonucleotide
gccccgtccgggagg

SEQ ID NO: 1337 - DNA, 15 bp, Artificial Sequence
  Description of Artificial Sequence: Synthetic oligonucleotide
tcggctcgctacaac

SEQ ID NO: 1338 - DNA, 15 bp, Artificial Sequence
  Description of Artificial Sequence: Synthetic oligonucleotide
gaccttatccccaac

SEQ ID NO: 1339 - DNA, 15 bp, Artificial Sequence
  Description of Artificial Sequence: Synthetic oligonucleotide
ctgatgccgagccga

SEQ ID NO: 1340 - DNA, 15 bp, Artificial Sequence
  Description of Artificial Sequence: Synthetic oligonucleotide
tgtgttggccgggcc

SEQ ID NO: 1341 - DNA, 15 bp, Artificial Sequence
  Description of Artificial Sequence: Synthetic oligonucleotide
accgggctggtctcc

SEQ ID NO: 1342 - DNA, 15 bp, Artificial Sequence
  Description of Artificial Sequence: Synthetic oligonucleotide
ctacggtctccctct

SEQ ID NO: 1343 - DNA, 15 bp, Artificial Sequence
  Description of Artificial Sequence: Synthetic oligonucleotide
gccatctcggctcac

SEQ ID NO: 1344 - DNA, 15 bp, Artificial Sequence
  Description of Artificial Sequence: Synthetic oligonucleotide
ctacacctcccagcc

SEQ ID NO: 1345 - DNA, 15 bp, Artificial Sequence
  Description of Artificial Sequence: Synthetic oligonucleotide
tttttgtattttttg

SEQ ID NO: 1346 - DNA, 15 bp, Artificial Sequence
  Description of Artificial Sequence: Synthetic oligonucleotide
tgtgttggccgggct

SEQ ID NO: 1347 - DNA, 15 bp, Artificial Sequence
  Description of Artificial Sequence: Synthetic oligonucleotide
ctctgcctaggaaaa

SEQ ID NO: 1348 - DNA, 15 bp, Artificial Sequence
  Description of Artificial Sequence: Synthetic oligonucleotide
ggacggtactgctgc

SEQ ID NO: 1349 - DNA, 15 bp, Artificial Sequence
  Description of Artificial Sequence: Synthetic oligonucleotide
cgggaagggtgggga

SEQ ID NO: 1350 - DNA, 15 bp, Artificial Sequence
  Description of Artificial Sequence: Synthetic oligonucleotide
cgcccggccgccatc

SEQ ID NO: 1351 - DNA, 15 bp, Artificial Sequence
  Description of Artificial Sequence: Synthetic oligonucleotide
tgctgtgtctgtgta

SEQ ID NO: 1352 - DNA, 15 bp, Artificial Sequence
  Description of Artificial Sequence: Synthetic oligonucleotide
atcaataaaaaaaaa

SEQ ID NO: 1353 - DNA, 15 bp, Artificial Sequence
  Description of Artificial Sequence: Synthetic oligonucleotide
ggtctccagctccta

SEQ ID NO: 1354 - DNA, 15 bp, Artificial Sequence
  Description of Artificial Sequence: Synthetic oligonucleotide
gctcattgagaacgg

SEQ ID NO: 1355 - DNA, 15 bp, Artificial Sequence
  Description of Artificial Sequence: Synthetic oligonucleotide
ggtctccagctcctg

SEQ ID NO: 1356 - DNA, 15 bp, Artificial Sequence
  Description of Artificial Sequence: Synthetic oligonucleotide
tctaggaagtgagga

SEQ ID NO: 1357 - DNA, 15 bp, Artificial Sequence
  Description of Artificial Sequence: Synthetic oligonucleotide
gttaaatggattaag

SEQ ID NO: 1358 - DNA, 15 bp, Artificial Sequence
  Description of Artificial Sequence: Synthetic oligonucleotide
ggggaaaagattgag

SEQ ID NO: 1359 - DNA, 15 bp, Artificial Sequence
  Description of Artificial Sequence: Synthetic oligonucleotide
ccctctctccacggt

SEQ ID NO: 1360 - DNA, 15 bp, Artificial Sequence
  Description of Artificial Sequence: Synthetic oligonucleotide
ggagcgcctccgccc

SEQ ID NO: 1361 - DNA, 15 bp, Artificial Sequence
  Description of Artificial Sequence: Synthetic oligonucleotide
agccgaagctggact

SEQ ID NO: 1362 - DNA, 15 bp, Artificial Sequence
  Description of Artificial Sequence: Synthetic oligonucleotide
cgccccgtctgggaa

SEQ ID NO: 1363 - DNA, 15 bp, Artificial Sequence
  Description of Artificial Sequence: Synthetic oligonucleotide
agcgcctctgcccgg

SEQ ID NO: 1364 - DNA, 15 bp, Artificial Sequence
  Description of Artificial Sequence: Synthetic oligonucleotide
ccagccgccccgtcc

SEQ ID NO: 1365 - DNA, 15 bp, Artificial Sequence
  Description of Artificial Sequence: Synthetic oligonucleotide
tgatcaataaaaaaa

SEQ ID NO: 1366 - DNA, 15 bp, Artificial Sequence
  Description of Artificial Sequence: Synthetic oligonucleotide
caaccctgtgctctc

SEQ ID NO: 1367 - DNA, 15 bp, Artificial Sequence
  Description of Artificial Sequence: Synthetic oligonucleotide
aaggcgggaagggtg

SEQ ID NO: 1368 - DNA, 15 bp, Artificial Sequence
  Description of Artificial Sequence: Synthetic oligonucleotide
gtactgctgccatct

SEQ ID NO: 1369 - DNA, 15 bp, Artificial Sequence
  Description of Artificial Sequence: Synthetic oligonucleotide
tgttgccgaggctgg

SEQ ID NO: 1370 - DNA, 15 bp, Artificial Sequence
  Description of Artificial Sequence: Synthetic oligonucleotide
ccagccgccccgtct

SEQ ID NO: 1371 - DNA, 15 bp, Artificial Sequence
  Description of Artificial Sequence: Synthetic oligonucleotide
tgaaacatgtgctgt

SEQ ID NO: 1372 - DNA, 15 bp, Artificial Sequence
  Description of Artificial Sequence: Synthetic oligonucleotide
gagattgcagcctct

SEQ ID NO: 1373 - DNA, 15 bp, Artificial Sequence
  Description of Artificial Sequence: Synthetic oligonucleotide
caaatccccctctcc

SEQ ID NO: 1374 - DNA, 15 bp, Artificial Sequence
  Description of Artificial Sequence: Synthetic oligonucleotide
ggcgcgcgccgccac

SEQ ID NO: 1375 - DNA, 15 bp, Artificial Sequence
  Description of Artificial Sequence: Synthetic oligonucleotide
aagtagacatgggag

SEQ ID NO: 1376 - DNA, 15 bp, Artificial Sequence
  Description of Artificial Sequence: Synthetic oligonucleotide
tcctatgaccctgcc

SEQ ID NO: 1377 - DNA, 15 bp, Artificial Sequence
  Description of Artificial Sequence: Synthetic oligonucleotide
atgcttgaaggcagc

SEQ ID NO: 1378 - DNA, 15 bp, Artificial Sequence
  Description of Artificial Sequence: Synthetic oligonucleotide
tccccctctgtgaga

SEQ ID NO: 1379 - DNA, 15 bp, Artificial Sequence
  Description of Artificial Sequence: Synthetic oligonucleotide
attgcagacggagtc

SEQ ID NO: 1380 - DNA, 15 bp, Artificial Sequence
  Description of Artificial Sequence: Synthetic oligonucleotide
ccttacccccaaccc

SEQ ID NO: 1381 - DNA, 15 bp, Artificial Sequence
  Description of Artificial Sequence: Synthetic oligonucleotide
ctggactgtactgcc

SEQ ID NO: 1382 - DNA, 15 bp, Artificial Sequence
  Description of Artificial Sequence: Synthetic oligonucleotide
ggacctctgcctagg

SEQ ID NO: 1383 - DNA, 15 bp, Artificial Sequence
  Description of Artificial Sequence: Synthetic oligonucleotide
cgccccgtctgggag

SEQ ID NO: 1384 - DNA, 15 bp, Artificial Sequence
  Description of Artificial Sequence: Synthetic oligonucleotide
cacttgtttatctgc

SEQ ID NO: 1385 - DNA, 15 bp, Artificial Sequence
  Description of Artificial Sequence: Synthetic oligonucleotide
ctgcaacctccctgc

SEQ ID NO: 1386 - DNA, 15 bp, Artificial Sequence
  Description of Artificial Sequence: Synthetic oligonucleotide
tgcgattgcaggcac

SEQ ID NO: 1387 - DNA, 15 bp, Artificial Sequence
  Description of Artificial Sequence: Synthetic oligonucleotide
ctctgttgccgaggc

SEQ ID NO: 1388 - DNA, 15 bp, Artificial Sequence
  Description of Artificial Sequence: Synthetic oligonucleotide
aaggccgcagggacc

SEQ ID NO: 1389 - DNA, 15 bp, Artificial Sequence
  Description of Artificial Sequence: Synthetic oligonucleotide
tgcctcggcctgccg

SEQ ID NO: 1390 - DNA, 15 bp, Artificial Sequence
  Description of Artificial Sequence: Synthetic oligonucleotide
gctcaatgttgccca

SEQ ID NO: 1391 - DNA, 15 bp, Artificial Sequence
  Description of Artificial Sequence: Synthetic oligonucleotide
cctctccctctcccc

SEQ ID NO: 1392 - DNA, 15 bp, Artificial Sequence
  Description of Artificial Sequence: Synthetic oligonucleotide
gggaggtgaggggcg

SEQ ID NO: 1393 - DNA, 15 bp, Artificial Sequence
  Description of Artificial Sequence: Synthetic oligonucleotide
gaggtggggggcgcc

SEQ ID NO: 1394 - DNA, 15 bp, Artificial Sequence
  Description of Artificial Sequence: Synthetic oligonucleotide
cagccgccccgtctg

SEQ ID NO: 1395 - DNA, 15 bp, Artificial Sequence
  Description of Artificial Sequence: Synthetic oligonucleotide
atgtgctgtgtccac

SEQ ID NO: 1396 - DNA, 15 bp, Artificial Sequence
  Description of Artificial Sequence: Synthetic oligonucleotide
cctctccctctccct

SEQ ID NO: 1397 - DNA, 15 bp, Artificial Sequence
  Description of Artificial Sequence: Synthetic oligonucleotide
ttcttctgccttggg

SEQ ID NO: 1398 - DNA, 15 bp, Artificial Sequence
  Description of Artificial Sequence: Synthetic oligonucleotide
ggagacttttcattt

SEQ ID NO: 1399 - DNA, 15 bp, Artificial Sequence
  Description of Artificial Sequence: Synthetic oligonucleotide
ggtttcgccgtgttg

SEQ ID NO: 1400 - DNA, 15 bp, Artificial Sequence
  Description of Artificial Sequence: Synthetic oligonucleotide
gcctcgggctccagt

SEQ ID NO: 1401 - DNA, 15 bp, Artificial Sequence
  Description of Artificial Sequence: Synthetic oligonucleotide
agctcctgaccgcga

SEQ ID NO: 1402 - DNA, 15 bp, Artificial Sequence
  Description of Artificial Sequence: Synthetic oligonucleotide
ctgcgattgcaggca

SEQ ID NO: 1403 - DNA, 15 bp, Artificial Sequence
  Description of Artificial Sequence: Synthetic oligonucleotide
ctgcgattgcaggcg

SEQ ID NO: 1404 - DNA, 15 bp, Artificial Sequence
  Description of Artificial Sequence: Synthetic oligonucleotide
gcctgccgagtgcct

SEQ ID NO: 1405 - DNA, 15 bp, Artificial Sequence
  Description of Artificial Sequence: Synthetic oligonucleotide
ttcccggccgccatc

SEQ ID NO: 1406 - DNA, 15 bp, Artificial Sequence
  Description of Artificial Sequence: Synthetic oligonucleotide
ctggactgtactgct

SEQ ID NO: 1407 - DNA, 15 bp, Artificial Sequence
  Description of Artificial Sequence: Synthetic oligonucleotide
cagattgttactgtg

SEQ ID NO: 1408 - DNA, 15 bp, Artificial Sequence
  Description of Artificial Sequence: Synthetic oligonucleotide
taaatactaaaaaaa

SEQ ID NO: 1409 - DNA, 15 bp, Artificial Sequence
  Description of Artificial Sequence: Synthetic oligonucleotide
aggagcgcctccgcc

SEQ ID NO: 1410 - DNA, 15 bp, Artificial Sequence
  Description of Artificial Sequence: Synthetic oligonucleotide
cgccccgtctgggat

SEQ ID NO: 1411 - DNA, 15 bp, Artificial Sequence
  Description of Artificial Sequence: Synthetic oligonucleotide
ggaaatgtggggaaa

SEQ ID NO: 1412 - DNA, 15 bp, Artificial Sequence
  Description of Artificial Sequence: Synthetic oligonucleotide
ctccacctcccagcc

SEQ ID NO: 1413 - DNA, 15 bp, Artificial Sequence
  Description of Artificial Sequence: Synthetic oligonucleotide
gtactgccgccatct

SEQ ID NO: 1414 - DNA, 15 bp, Artificial Sequence
  Description of Artificial Sequence: Synthetic oligonucleotide
tcttctgccttggga

SEQ ID NO: 1415 - DNA, 15 bp, Artificial Sequence
  Description of Artificial Sequence: Synthetic oligonucleotide
gtgaggagcccctct

SEQ ID NO: 1416 - DNA, 15 bp, Artificial Sequence
  Description of Artificial Sequence: Synthetic oligonucleotide
gagcacctctgcccc

SEQ ID NO: 1417 - DNA, 15 bp, Artificial Sequence
  Description of Artificial Sequence: Synthetic oligonucleotide
ttatcctatgaccct

SEQ ID NO: 1418 - DNA, 15 bp, Artificial Sequence
  Description of Artificial Sequence: Synthetic oligonucleotide
cttaagtacccaggg

SEQ ID NO: 1419 - DNA, 15 bp, Artificial Sequence
  Description of Artificial Sequence: Synthetic oligonucleotide
gatgtgaggagcgcc

SEQ ID NO: 1420 - DNA, 15 bp, Artificial Sequence
  Description of Artificial Sequence: Synthetic oligonucleotide
cccagtctgggaagt

SEQ ID NO: 1421 - DNA, 15 bp, Artificial Sequence
  Description of Artificial Sequence: Synthetic oligonucleotide
gatcagattgttact

SEQ ID NO: 1422 - DNA, 15 bp, Artificial Sequence
  Description of Artificial Sequence: Synthetic oligonucleotide
ccgccagcctcggcc

SEQ ID NO: 1423 - DNA, 15 bp, Artificial Sequence
  Description of Artificial Sequence: Synthetic oligonucleotide
tgtcccctctttcca

SEQ ID NO: 1424 - DNA, 15 bp, Artificial Sequence
  Description of Artificial Sequence: Synthetic oligonucleotide
acttgtttatctgct

SEQ ID NO: 1425 - DNA, 15 bp, Artificial Sequence
  Description of Artificial Sequence: Synthetic oligonucleotide
ctctctgaaacatgt

SEQ ID NO: 1426 - DNA, 15 bp, Artificial Sequence
  Description of Artificial Sequence: Synthetic oligonucleotide
gacggtactgctgcc

SEQ ID NO: 1427 - DNA, 15 bp, Artificial Sequence
  Description of Artificial Sequence: Synthetic oligonucleotide
gcacgcgccgccacg

SEQ ID NO: 1428 - DNA, 15 bp, Artificial Sequence
  Description of Artificial Sequence: Synthetic oligonucleotide
ggagcgcctcttccc

SEQ ID NO: 1429 - DNA, 15 bp, Artificial Sequence
  Description of Artificial Sequence: Synthetic oligonucleotide
cattttgttctgtac

SEQ ID NO: 1430 - DNA, 15 bp, Artificial Sequence
  Description of Artificial Sequence: Synthetic oligonucleotide
ggaggtgtgcccagc

SEQ ID NO: 1431 - DNA, 15 bp, Artificial Sequence
  Description of Artificial Sequence: Synthetic oligonucleotide
aaccgcgagtgatcc

SEQ ID NO: 1432 - DNA, 15 bp, Artificial Sequence
  Description of Artificial Sequence: Synthetic oligonucleotide
gtactgccgtgatct

SEQ ID NO: 1433 - DNA, 15 bp, Artificial Sequence
  Description of Artificial Sequence: Synthetic oligonucleotide
caagatgtgctttgt

SEQ ID NO: 1434 - DNA, 15 bp, Artificial Sequence
  Description of Artificial Sequence: Synthetic oligonucleotide
cctcagcctgccgag

SEQ ID NO: 1435 - DNA, 15 bp, Artificial Sequence
  Description of Artificial Sequence: Synthetic oligonucleotide
tgcaacctccctgcc

SEQ ID NO: 1436 - DNA, 15 bp, Artificial Sequence
  Description of Artificial Sequence: Synthetic oligonucleotide
cctcgggctccagtg

SEQ ID NO: 1437 - DNA, 15 bp, Artificial Sequence
  Description of Artificial Sequence: Synthetic oligonucleotide
ccctctgcgagaaac

SEQ ID NO: 1438 - DNA, 15 bp, Artificial Sequence
  Description of Artificial Sequence: Synthetic oligonucleotide
cagtgctcaatgttg

SEQ ID NO: 1439 - DNA, 15 bp, Artificial Sequence
  Description of Artificial Sequence: Synthetic oligonucleotide
ggagcgtctctgcct

SEQ ID NO: 1440 - DNA, 15 bp, Artificial Sequence
  Description of Artificial Sequence: Synthetic oligonucleotide
gccgtgatctcggct

SEQ ID NO: 1441 - DNA, 15 bp, Artificial Sequence
  Description of Artificial Sequence: Synthetic oligonucleotide
cctctgcccggccgc

SEQ ID NO: 1442 - DNA, 15 bp, Artificial Sequence
  Description of Artificial Sequence: Synthetic oligonucleotide
catgcggagccgaag

SEQ ID NO: 1443 - DNA, 15 bp, Artificial Sequence
  Description of Artificial Sequence: Synthetic oligonucleotide
cttcattttgttctg

SEQ ID NO: 1444 - DNA, 15 bp, Artificial Sequence
  Description of Artificial Sequence: Synthetic oligonucleotide
gaggtgtgcccagcg

SEQ ID NO: 1445 - DNA, 15 bp, Artificial Sequence
  Description of Artificial Sequence: Synthetic oligonucleotide
ggagcgtctctgccc

SEQ ID NO: 1446 - DNA, 15 bp, Artificial Sequence
  Description of Artificial Sequence: Synthetic oligonucleotide
tctataaccttaccc

SEQ ID NO: 1447 - DNA, 15 bp, Artificial Sequence
  Description of Artificial Sequence: Synthetic oligonucleotide
gggtcctctgcctag

SEQ ID NO: 1448 - DNA, 15 bp, Artificial Sequence
  Description of Artificial Sequence: Synthetic oligonucleotide
acatgggagactttt

SEQ ID NO: 1449 - DNA, 15 bp, Artificial Sequence
  Description of Artificial Sequence: Synthetic oligonucleotide
ctttctacggtctcc

SEQ ID NO: 1450 - DNA, 15 bp, Artificial Sequence
  Description of Artificial Sequence: Synthetic oligonucleotide
acccccaaccctgtg

SEQ ID NO: 1451 - DNA, 15 bp, Artificial Sequence
  Description of Artificial Sequence: Synthetic oligonucleotide
tgatgacaatggcgg

SEQ ID NO: 1452 - DNA, 15 bp, Artificial Sequence
  Description of Artificial Sequence: Synthetic oligonucleotide
tgggaggtggggggc

SEQ ID NO: 1453 - DNA, 15 bp, Artificial Sequence
  Description of Artificial Sequence: Synthetic oligonucleotide
cctccgcccggccgc

SEQ ID NO: 1454 - DNA, 15 bp, Artificial Sequence
  Description of Artificial Sequence: Synthetic oligonucleotide
tgacgatggcggttt

SEQ ID NO: 1455 - DNA, 15 bp, Artificial Sequence
  Description of Artificial Sequence: Synthetic oligonucleotide
tctccctctgttgcc

SEQ ID NO: 1456 - DNA, 15 bp, Artificial Sequence
  Description of Artificial Sequence: Synthetic oligonucleotide
cggccgccaccccgt

SEQ ID NO: 1457 - DNA, 15 bp, Artificial Sequence
  Description of Artificial Sequence: Synthetic oligonucleotide
aaaaaaaattaaaaa

SEQ ID NO: 1458 - DNA, 15 bp, Artificial Sequence
  Description of Artificial Sequence: Synthetic oligonucleotide
aaatggattaagggc

SEQ ID NO: 1459 - DNA, 15 bp, Artificial Sequence
  Description of Artificial Sequence: Synthetic oligonucleotide
cattgagaacgggcc

SEQ ID NO: 1460 - DNA, 15 bp, Artificial Sequence
  Description of Artificial Sequence: Synthetic oligonucleotide
ggatgtggggagcac

SEQ ID NO: 1461 - DNA, 15 bp, Artificial Sequence
  Description of Artificial Sequence: Synthetic oligonucleotide
tgtggggaaaagaaa

SEQ ID NO: 1462 - DNA, 15 bp, Artificial Sequence
  Description of Artificial Sequence: Synthetic oligonucleotide
cgtctgggaggaggt

SEQ ID NO: 1463 - DNA, 15 bp, Artificial Sequence
  Description of Artificial Sequence: Synthetic oligonucleotide
catcgtctgagatgt

SEQ ID NO: 1464 - DNA, 15 bp, Artificial Sequence
  Description of Artificial Sequence: Synthetic oligonucleotide
cggccaccaccccgt

SEQ ID NO: 1465 - DNA, 15 bp, Artificial Sequence
  Description of Artificial Sequence: Synthetic oligonucleotide
ccctctccgagaaac

SEQ ID NO: 1466 - DNA, 15 bp, Artificial Sequence
  Description of Artificial Sequence: Synthetic oligonucleotide
cccggccaccgcccc

SEQ ID NO: 1467 - DNA, 15 bp, Artificial Sequence
  Description of Artificial Sequence: Synthetic oligonucleotide
gtacccaacagctca

SEQ ID NO: 1468 - DNA, 15 bp, Artificial Sequence
  Description of Artificial Sequence: Synthetic oligonucleotide
ggagtctcgttcact

SEQ ID NO: 1469 - DNA, 15 bp, Artificial Sequence
  Description of Artificial Sequence: Synthetic oligonucleotide
acacccaagaatgat

SEQ ID NO: 1470 - DNA, 15 bp, Artificial Sequence
  Description of Artificial Sequence: Synthetic oligonucleotide
tcgtctgggatgtgg

SEQ ID NO: 1471 - DNA, 15 bp, Artificial Sequence
  Description of Artificial Sequence: Synthetic oligonucleotide
gcgagaaacacccaa

SEQ ID NO: 1472 - DNA, 15 bp, Artificial Sequence
  Description of Artificial Sequence: Synthetic oligonucleotide
tcgtctgggatgtga

SEQ ID NO: 1473 - DNA, 15 bp, Artificial Sequence
  Description of Artificial Sequence: Synthetic oligonucleotide
tctccctctgatgcc

SEQ ID NO: 1474 - DNA, 15 bp, Artificial Sequence
  Description of Artificial Sequence: Synthetic oligonucleotide
ggaagtgaggagcgt

SEQ ID NO: 1475 - DNA, 15 bp, Artificial Sequence
  Description of Artificial Sequence: Synthetic oligonucleotide
ctcaatgttgcccag

SEQ ID NO: 1476 - DNA, 15 bp, Artificial Sequence
  Description of Artificial Sequence: Synthetic oligonucleotide
cctggccgcccatcg

SEQ ID NO: 1477 - DNA, 15 bp, Artificial Sequence
  Description of Artificial Sequence: Synthetic oligonucleotide
gaaaaaattgagaaa

SEQ ID NO: 1478 - DNA, 15 bp, Artificial Sequence
  Description of Artificial Sequence: Synthetic oligonucleotide
atgggagacttttca

SEQ ID NO: 1479 - DNA, 15 bp, Artificial Sequence
  Description of Artificial Sequence: Synthetic oligonucleotide
agcccctaaccgcga

SEQ ID NO: 1480 - DNA, 15 bp, Artificial Sequence
  Description of Artificial Sequence: Synthetic oligonucleotide
catcccgtctaggaa

SEQ ID NO: 1481 - DNA, 15 bp, Artificial Sequence
  Description of Artificial Sequence: Synthetic oligonucleotide
tgttactgtgtctgt

SEQ ID NO: 1482 - DNA, 15 bp, Artificial Sequence
  Description of Artificial Sequence: Synthetic oligonucleotide
cgagtgatctgcccg

SEQ ID NO: 1483 - DNA, 15 bp, Artificial Sequence
  Description of Artificial Sequence: Synthetic oligonucleotide
ggccgccccgtctgg

SEQ ID NO: 1484 - DNA, 15 bp, Artificial Sequence
  Description of Artificial Sequence: Synthetic oligonucleotide
ctcccgaggtgctgg

SEQ ID NO: 1485 - DNA, 15 bp, Artificial Sequence
  Description of Artificial Sequence: Synthetic oligonucleotide
gtgttggccgggccg

SEQ ID NO: 1486 - DNA, 15 bp, Artificial Sequence
  Description of Artificial Sequence: Synthetic oligonucleotide
cccaggctggagtgc

SEQ ID NO: 1487 - DNA, 15 bp, Artificial Sequence
  Description of Artificial Sequence: Synthetic oligonucleotide
gaccattgagaacgg

SEQ ID NO: 1488 - DNA, 15 bp, Artificial Sequence
  Description of Artificial Sequence: Synthetic oligonucleotide
tctcatgcggagccg

SEQ ID NO: 1489 - DNA, 15 bp, Artificial Sequence
  Description of Artificial Sequence: Synthetic oligonucleotide
caccaccccgtctgg

SEQ ID NO: 1490 - DNA, 15 bp, Artificial Sequence
  Description of Artificial Sequence: Synthetic oligonucleotide
gtgaggagcgtctct

SEQ ID NO: 1491 - DNA, 15 bp, Artificial Sequence
  Description of Artificial Sequence: Synthetic oligonucleotide
aaccagagacctttg

SEQ ID NO: 1492 - DNA, 15 bp, Artificial Sequence
  Description of Artificial Sequence: Synthetic oligonucleotide
cccctactgggaagt

SEQ ID NO: 1493 - DNA, 15 bp, Artificial Sequence
  Description of Artificial Sequence: Synthetic oligonucleotide
actattatcctatga

SEQ ID NO: 1494 - DNA, 15 bp, Artificial Sequence
  Description of Artificial Sequence: Synthetic oligonucleotide
agtgaggagcgcctc

SEQ ID NO: 1495 - DNA, 15 bp, Artificial Sequence
  Description of Artificial Sequence: Synthetic oligonucleotide
ttgttctgtactaag

SEQ ID NO: 1496 - DNA, 15 bp, Artificial Sequence
  Description of Artificial Sequence: Synthetic oligonucleotide
aaatccccctctccg

SEQ ID NO: 1497 - DNA, 15 bp, Artificial Sequence
  Description of Artificial Sequence: Synthetic oligonucleotide
gctttgtggaataga

SEQ ID NO: 1498 - DNA, 15 bp, Artificial Sequence
  Description of Artificial Sequence: Synthetic oligonucleotide
cagatgcttgaaggc

SEQ ID NO: 1499 - DNA, 15 bp, Artificial Sequence
  Description of Artificial Sequence: Synthetic oligonucleotide
gctgtgtctgtgtag

SEQ ID NO: 1500 - DNA, 15 bp, Artificial Sequence
  Description of Artificial Sequence: Synthetic oligonucleotide
ctattgtcccatgac

SEQ ID NO: 1501 - DNA, 15 bp, Artificial Sequence
  Description of Artificial Sequence: Synthetic oligonucleotide
tcactcagtgctcaa

SEQ ID NO: 1502 - DNA, 15 bp, Artificial Sequence
  Description of Artificial Sequence: Synthetic oligonucleotide
tggggggcgcctctg

SEQ ID NO: 1503 - DNA, 15 bp, Artificial Sequence
  Description of Artificial Sequence: Synthetic oligonucleotide
ccggccagccgcccc

SEQ ID NO: 1504 - DNA, 15 bp, Artificial Sequence
  Description of Artificial Sequence: Synthetic oligonucleotide
ctggccgcccagtct

SEQ ID NO: 1505 - DNA, 15 bp, Artificial Sequence
  Description of Artificial Sequence: Synthetic oligonucleotide
aagaagtagacatgg

SEQ ID NO: 1506 - DNA, 15 bp, Artificial Sequence
  Description of Artificial Sequence: Synthetic oligonucleotide
aaattaaaaaaaaaa

SEQ ID NO: 1507 - DNA, 15 bp, Artificial Sequence
  Description of Artificial Sequence: Synthetic oligonucleotide
ctgcccggccgccac

SEQ ID NO: 1508 - DNA, 15 bp, Artificial Sequence
  Description of Artificial Sequence: Synthetic oligonucleotide
ggagccgaagctgga

SEQ ID NO: 1509 - DNA, 15 bp, Artificial Sequence
  Description of Artificial Sequence: Synthetic oligonucleotide
cctctgcctggccgc

SEQ ID NO: 1510 - DNA, 15 bp, Artificial Sequence
  Description of Artificial Sequence: Synthetic oligonucleotide
ggtctccagccccta

SEQ ID NO: 1511 - DNA, 15 bp, Artificial Sequence
  Description of Artificial Sequence: Synthetic oligonucleotide
ctgcccggccgccat

SEQ ID NO: 1512 - DNA, 15 bp, Artificial Sequence
  Description of Artificial Sequence: Synthetic oligonucleotide
aacagatgcttgaag

SEQ ID NO: 1513 - DNA, 15 bp, Artificial Sequence
  Description of Artificial Sequence: Synthetic oligonucleotide
attgtcccatgaccc

SEQ ID NO: 1514 - DNA, 15 bp, Artificial Sequence
  Description of Artificial Sequence: Synthetic oligonucleotide
gtcctatgaccctgc

SEQ ID NO: 1515 - DNA, 15 bp, Artificial Sequence
  Description of Artificial Sequence: Synthetic oligonucleotide
gaggctggactgtac

SEQ ID NO: 1516 - DNA, 15 bp, Artificial Sequence
  Description of Artificial Sequence: Synthetic oligonucleotide
tccctctcatgcgga

SEQ ID NO: 1517 - DNA, 15 bp, Artificial Sequence
  Description of Artificial Sequence: Synthetic oligonucleotide
gggccaggatgacaa

SEQ ID NO: 1518 - DNA, 15 bp, Artificial Sequence
  Description of Artificial Sequence: Synthetic oligonucleotide
ttttgtattttttgg

SEQ ID NO: 1519 - DNA, 15 bp, Artificial Sequence
  Description of Artificial Sequence: Synthetic oligonucleotide
gaaaagattgagaaa

SEQ ID NO: 1520 - DNA, 15 bp, Artificial Sequence
  Description of Artificial Sequence: Synthetic oligonucleotide
ctctccctctccctc

SEQ ID NO: 1521 - DNA, 15 bp, Artificial Sequence
  Description of Artificial Sequence: Synthetic oligonucleotide
cgtctgggatgtggg

SEQ ID NO: 1522 - DNA, 15 bp, Artificial Sequence
  Description of Artificial Sequence: Synthetic oligonucleotide
gtatttttggtggag

SEQ ID NO: 1523 - DNA, 15 bp, Artificial Sequence
  Description of Artificial Sequence: Synthetic oligonucleotide
tgcctcgggctccag

SEQ ID NO: 1524 - DNA, 15 bp, Artificial Sequence
  Description of Artificial Sequence: Synthetic oligonucleotide
ggccgggctggtctc

SEQ ID NO: 1525 - DNA, 15 bp, Artificial Sequence
  Description of Artificial Sequence: Synthetic oligonucleotide
aacctacacctccca

SEQ ID NO: 1526 - DNA, 15 bp, Artificial Sequence
  Description of Artificial Sequence: Synthetic oligonucleotide
ctctttctacggtct

SEQ ID NO: 1527 - DNA, 15 bp, Artificial Sequence
  Description of Artificial Sequence: Synthetic oligonucleotide
ccatcccgtctggga

SEQ ID NO: 1528 - DNA, 15 bp, Artificial Sequence
  Description of Artificial Sequence: Synthetic oligonucleotide
gggacctctgcctag

SEQ ID NO: 1529 - DNA, 15 bp, Artificial Sequence
  Description of Artificial Sequence: Synthetic oligonucleotide
cccatcgtctgggat

SEQ ID NO: 1530 - DNA, 15 bp, Artificial Sequence
  Description of Artificial Sequence: Synthetic oligonucleotide
ctgatgccgagccaa

SEQ ID NO: 1531 - DNA, 15 bp, Artificial Sequence
  Description of Artificial Sequence: Synthetic oligonucleotide
agtgatccgccagcc

SEQ ID NO: 1532 - DNA, 15 bp, Artificial Sequence
  Description of Artificial Sequence: Synthetic oligonucleotide
tctctccactattat

SEQ ID NO: 1533 - DNA, 15 bp, Artificial Sequence
  Description of Artificial Sequence: Synthetic oligonucleotide
gccatcccatctagg

SEQ ID NO: 1534 - DNA, 15 bp, Artificial Sequence
  Description of Artificial Sequence: Synthetic oligonucleotide
tttcgctgtgttggc

SEQ ID NO: 1535 - DNA, 15 bp, Artificial Sequence
  Description of Artificial Sequence: Synthetic oligonucleotide
ccgccgccccgtctg

SEQ ID NO: 1536 - DNA, 15 bp, Artificial Sequence
  Description of Artificial Sequence: Synthetic oligonucleotide
gtttttgtatttttg

SEQ ID NO: 1537 - DNA, 15 bp, Artificial Sequence
  Description of Artificial Sequence: Synthetic oligonucleotide
tgtagaaagaagtag

SEQ ID NO: 1538 - DNA, 15 bp, Artificial Sequence
  Description of Artificial Sequence: Synthetic oligonucleotide
ccgccacgcctgact

SEQ ID NO: 1539 - DNA, 15 bp, Artificial Sequence
  Description of Artificial Sequence: Synthetic oligonucleotide
tgcccaacagctcat

SEQ ID NO: 1540 - DNA, 15 bp, Artificial Sequence
  Description of Artificial Sequence: Synthetic oligonucleotide
gatgccgagccgaag

SEQ ID NO: 1541 - DNA, 15 bp, Artificial Sequence
  Description of Artificial Sequence: Synthetic oligonucleotide
taagattgcagcctc

SEQ ID NO: 1542 - DNA, 15 bp, Artificial Sequence
  Description of Artificial Sequence: Synthetic oligonucleotide
tcgctacaacctcca

SEQ ID NO: 1543 - DNA, 15 bp, Artificial Sequence
  Description of Artificial Sequence: Synthetic oligonucleotide
gtttttgtatttttt

SEQ ID NO: 1544 - DNA, 15 bp, Artificial Sequence
  Description of Artificial Sequence: Synthetic oligonucleotide
atcctgttgatctgt

SEQ ID NO: 1545 - DNA, 15 bp, Artificial Sequence
  Description of Artificial Sequence: Synthetic oligonucleotide
gccgagattgcagcc

SEQ ID NO: 1546 - DNA, 15 bp, Artificial Sequence
  Description of Artificial Sequence: Synthetic oligonucleotide
tcagtgctcaatggt

SEQ ID NO: 1547 - DNA, 15 bp, Artificial Sequence
  Description of Artificial Sequence: Synthetic oligonucleotide
accctgccaaatccc

SEQ ID NO: 1548 - DNA, 15 bp, Artificial Sequence
  Description of Artificial Sequence: Synthetic oligonucleotide
tccactattgtccca

SEQ ID NO: 1549 - DNA, 15 bp, Artificial Sequence
  Description of Artificial Sequence: Synthetic oligonucleotide
ggactgtactgctgc

SEQ ID NO: 1550 - DNA, 15 bp, Artificial Sequence
  Description of Artificial Sequence: Synthetic oligonucleotide
tgtgtggatagaagt

SEQ ID NO: 1551 - DNA, 15 bp, Artificial Sequence
  Description of Artificial Sequence: Synthetic oligonucleotide
tctgggaggtgtacc

SEQ ID NO: 1552 - DNA, 15 bp, Artificial Sequence
  Description of Artificial Sequence: Synthetic oligonucleotide
tcattgagaacgggc

SEQ ID NO: 1553 - DNA, 15 bp, Artificial Sequence
  Description of Artificial Sequence: Synthetic oligonucleotide
gatgacgatggcggt

SEQ ID NO: 1554 - DNA, 15 bp, Artificial Sequence
  Description of Artificial Sequence: Synthetic oligonucleotide
cctgggattgcaggc

SEQ ID NO: 1555 - DNA, 15 bp, Artificial Sequence
  Description of Artificial Sequence: Synthetic oligonucleotide
acggagtctcgttca

SEQ ID NO: 1556 - DNA, 15 bp, Artificial Sequence
  Description of Artificial Sequence: Synthetic oligonucleotide
gcaggcgcgcgccgc

SEQ ID NO: 1557 - DNA, 15 bp, Artificial Sequence
  Description of Artificial Sequence: Synthetic oligonucleotide
gagcgcctcttcccg

SEQ ID NO: 1558 - DNA, 15 bp, Artificial Sequence
  Description of Artificial Sequence: Synthetic oligonucleotide
cctctgcccggccag

SEQ ID NO: 1559 - DNA, 15 bp, Artificial Sequence
  Description of Artificial Sequence: Synthetic oligonucleotide
ccagccgcctgcctt

SEQ ID NO: 1560 - DNA, 15 bp, Artificial Sequence
  Description of Artificial Sequence: Synthetic oligonucleotide
ggaggtgtgcccaac

SEQ ID NO: 1561 - DNA, 15 bp, Artificial Sequence
  Description of Artificial Sequence: Synthetic oligonucleotide
aagaaaaattcttct

SEQ ID NO: 1562 - DNA, 15 bp, Artificial Sequence
  Description of Artificial Sequence: Synthetic oligonucleotide
tacccccaaccccgt

SEQ ID NO: 1563 - DNA, 15 bp, Artificial Sequence
  Description of Artificial Sequence: Synthetic oligonucleotide
ttgcagacggagtct

SEQ ID NO: 1564 - DNA, 15 bp, Artificial Sequence
  Description of Artificial Sequence: Synthetic oligonucleotide
gaccttctctccact

SEQ ID NO: 1565 - DNA, 15 bp, Artificial Sequence
  Description of Artificial Sequence: Synthetic oligonucleotide
accacctcccagccg

SEQ ID NO: 1566 - DNA, 15 bp, Artificial Sequence
  Description of Artificial Sequence: Synthetic oligonucleotide
tctcccctctttcca

SEQ ID NO: 1567 - DNA, 15 bp, Artificial Sequence
  Description of Artificial Sequence: Synthetic oligonucleotide
cgtctaggaagtgag

SEQ ID NO: 1568 - DNA, 15 bp, Artificial Sequence
  Description of Artificial Sequence: Synthetic oligonucleotide
gcggttttgtggaat

SEQ ID NO: 1569 - DNA, 15 bp, Artificial Sequence
  Description of Artificial Sequence: Synthetic oligonucleotide
cctgactggttttcg

SEQ ID NO: 1570 - DNA, 15 bp, Artificial Sequence
  Description of Artificial Sequence: Synthetic oligonucleotide
ccccgtctgggaagt

SEQ ID NO: 1571 - DNA, 15 bp, Artificial Sequence
  Description of Artificial Sequence: Synthetic oligonucleotide
tactgccgtgatctc

SEQ ID NO: 1572 - DNA, 15 bp, Artificial Sequence
  Description of Artificial Sequence: Synthetic oligonucleotide
cgaatagaaaagggg

SEQ ID NO: 1573 - DNA, 15 bp, Artificial Sequence
  Description of Artificial Sequence: Synthetic oligonucleotide
gggagacttttcatt

SEQ ID NO: 1574 - DNA, 15 bp, Artificial Sequence
  Description of Artificial Sequence: Synthetic oligonucleotide
tgcccggccgccacc

SEQ ID NO: 1575 - DNA, 15 bp, Artificial Sequence
  Description of Artificial Sequence: Synthetic oligonucleotide
atggattaagggcgg

SEQ ID NO: 1576 - DNA, 15 bp, Artificial Sequence
  Description of Artificial Sequence: Synthetic oligonucleotide
tacggtctccctctg

SEQ ID NO: 1577 - DNA, 15 bp, Artificial Sequence
  Description of Artificial Sequence: Synthetic oligonucleotide
cccgcccggccagcc

SEQ ID NO: 1578 - DNA, 15 bp, Artificial Sequence
  Description of Artificial Sequence: Synthetic oligonucleotide
ggagacttcattttg

SEQ ID NO: 1579 - DNA, 15 bp, Artificial Sequence
  Description of Artificial Sequence: Synthetic oligonucleotide
tctacggtctccctc

SEQ ID NO: 1580 - DNA, 15 bp, Artificial Sequence
  Description of Artificial Sequence: Synthetic oligonucleotide
attctcctgcctcag

SEQ ID NO: 1581 - DNA, 15 bp, Artificial Sequence
  Description of Artificial Sequence: Synthetic oligonucleotide
cggccgcccatcgtc

SEQ ID NO: 1582 - DNA, 15 bp, Artificial Sequence
  Description of Artificial Sequence: Synthetic oligonucleotide
agctggactgtactg

SEQ ID NO: 1583 - DNA, 15 bp, Artificial Sequence
  Description of Artificial Sequence: Synthetic oligonucleotide
ccactattgtcctat

SEQ ID NO: 1584 - DNA, 15 bp, Artificial Sequence
  Description of Artificial Sequence: Synthetic oligonucleotide
atgctgttaatctat

SEQ ID NO: 1585 - DNA, 15 bp, Artificial Sequence
  Description of Artificial Sequence: Synthetic oligonucleotide
gcctcagcctgccga

SEQ ID NO: 1586 - DNA, 15 bp, Artificial Sequence
  Description of Artificial Sequence: Synthetic oligonucleotide
ggggtttcgctgtgt

SEQ ID NO: 1587 - DNA, 15 bp, Artificial Sequence
  Description of Artificial Sequence: Synthetic oligonucleotide
accaccccgtctggg

SEQ ID NO: 1588 - DNA, 15 bp, Artificial Sequence
  Description of Artificial Sequence: Synthetic oligonucleotide
tctgcctaggaaaac

SEQ ID NO: 1589 - DNA, 15 bp, Artificial Sequence
  Description of Artificial Sequence: Synthetic oligonucleotide
cggttttgtggaata

SEQ ID NO: 1590 - DNA, 15 bp, Artificial Sequence
  Description of Artificial Sequence: Synthetic oligonucleotide
gacggagtctcgctc

SEQ ID NO: 1591 - DNA, 15 bp, Artificial Sequence
  Description of Artificial Sequence: Synthetic oligonucleotide
ccgccatcccgtcta

SEQ ID NO: 1592 - DNA, 15 bp, Artificial Sequence
  Description of Artificial Sequence: Synthetic oligonucleotide
gagccggattgcagc

SEQ ID NO: 1593 - DNA, 15 bp, Artificial Sequence
  Description of Artificial Sequence: Synthetic oligonucleotide
gcggtgcaagatgtg

SEQ ID NO: 1594 - DNA, 15 bp, Artificial Sequence
  Description of Artificial Sequence: Synthetic oligonucleotide
cataggagactccat

SEQ ID NO: 1595 - DNA, 15 bp, Artificial Sequence
  Description of Artificial Sequence: Synthetic oligonucleotide
cctccacctcccagc

SEQ ID NO: 1596 - DNA, 15 bp, Artificial Sequence
  Description of Artificial Sequence: Synthetic oligonucleotide
aaagagccggattgc

SEQ ID NO: 1597 - DNA, 15 bp, Artificial Sequence
  Description of Artificial Sequence: Synthetic oligonucleotide
gaacgggccaggatg

SEQ ID NO: 1598 - DNA, 15 bp, Artificial Sequence
  Description of Artificial Sequence: Synthetic oligonucleotide
ggtgggggggtcagc

SEQ ID NO: 1599 - DNA, 15 bp, Artificial Sequence
  Description of Artificial Sequence: Synthetic oligonucleotide
gccccgtctgggatg

SEQ ID NO: 1600 - DNA, 15 bp, Artificial Sequence
  Description of Artificial Sequence: Synthetic oligonucleotide
cgaggtgccgggatt

SEQ ID NO: 1601 - DNA, 15 bp, Artificial Sequence
  Description of Artificial Sequence: Synthetic oligonucleotide
tctgtgtggatagaa

SEQ ID NO: 1602 - DNA, 15 bp, Artificial Sequence
  Description of Artificial Sequence: Synthetic oligonucleotide
ctcgctgcaacctcc

SEQ ID NO: 1603 - DNA, 15 bp, Artificial Sequence
  Description of Artificial Sequence: Synthetic oligonucleotide
gattctcctgcctca

SEQ ID NO: 1604 - DNA, 15 bp, Artificial Sequence
  Description of Artificial Sequence: Synthetic oligonucleotide
ctattgtcctatgac

SEQ ID NO: 1605 - DNA, 15 bp, Artificial Sequence
  Description of Artificial Sequence: Synthetic oligonucleotide
ctccacggtctccct

SEQ ID NO: 1606 - DNA, 15 bp, Artificial Sequence
  Description of Artificial Sequence: Synthetic oligonucleotide
gcagcatgctcgtta

SEQ ID NO: 1607 - DNA, 15 bp, Artificial Sequence
  Description of Artificial Sequence: Synthetic oligonucleotide
tccctctccctgtcc

SEQ ID NO: 1608 - DNA, 15 bp, Artificial Sequence
  Description of Artificial Sequence: Synthetic oligonucleotide
ctgtgctctctgaaa

SEQ ID NO: 1609 - DNA, 15 bp, Artificial Sequence
  Description of Artificial Sequence: Synthetic oligonucleotide
ccgagccgaagctgg

SEQ ID NO: 1610 - DNA, 15 bp, Artificial Sequence
  Description of Artificial Sequence: Synthetic oligonucleotide
actgtactgccgtga

SEQ ID NO: 1611 - DNA, 15 bp, Artificial Sequence
  Description of Artificial Sequence: Synthetic oligonucleotide
gagtgcagtggcgtg

SEQ ID NO: 1612 - DNA, 15 bp, Artificial Sequence
  Description of Artificial Sequence: Synthetic oligonucleotide
tgagaacgggccatg

SEQ ID NO: 1613 - DNA, 15 bp, Artificial Sequence
  Description of Artificial Sequence: Synthetic oligonucleotide
agtgaggagcccctc

SEQ ID NO: 1614 - DNA, 15 bp, Artificial Sequence
  Description of Artificial Sequence: Synthetic oligonucleotide
cggctcattggggat

SEQ ID NO: 1615 - DNA, 15 bp, Artificial Sequence
  Description of Artificial Sequence: Synthetic oligonucleotide
tggttttggtggaga

SEQ ID NO: 1616 - DNA, 15 bp, Artificial Sequence
  Description of Artificial Sequence: Synthetic oligonucleotide
caaatccccctctgc

SEQ ID NO: 1617 - DNA, 15 bp, Artificial Sequence
  Description of Artificial Sequence: Synthetic oligonucleotide
agggtcctctgccta

SEQ ID NO: 1618 - DNA, 15 bp, Artificial Sequence
  Description of Artificial Sequence: Synthetic oligonucleotide
cccctctgcgagaaa

SEQ ID NO: 1619 - DNA, 15 bp, Artificial Sequence
  Description of Artificial Sequence: Synthetic oligonucleotide
agtgattctcctgcc

SEQ ID NO: 1620 - DNA, 15 bp, Artificial Sequence
  Description of Artificial Sequence: Synthetic oligonucleotide
cacctctgccccgcc

SEQ ID NO: 1621 - DNA, 15 bp, Artificial Sequence
  Description of Artificial Sequence: Synthetic oligonucleotide
tgtgcccagcggctc

SEQ ID NO: 1622 - DNA, 15 bp, Artificial Sequence
  Description of Artificial Sequence: Synthetic oligonucleotide
cacaaacactgcgga

SEQ ID NO: 1623 - DNA, 15 bp, Artificial Sequence
  Description of Artificial Sequence: Synthetic oligonucleotide
caaatccccctctgt

SEQ ID NO: 1624 - DNA, 15 bp, Artificial Sequence
  Description of Artificial Sequence: Synthetic oligonucleotide
tgactggttttggtg

SEQ ID NO: 1625 - DNA, 15 bp, Artificial Sequence
  Description of Artificial Sequence: Synthetic oligonucleotide
ccgaggtgctgggat

SEQ ID NO: 1626 - DNA, 15 bp, Artificial Sequence
  Description of Artificial Sequence: Synthetic oligonucleotide
tgcctgattctcctg

SEQ ID NO: 1627 - DNA, 15 bp, Artificial Sequence
  Description of Artificial Sequence: Synthetic oligonucleotide
ccagctcctgaccgc

SEQ ID NO: 1628 - DNA, 15 bp, Artificial Sequence
  Description of Artificial Sequence: Synthetic oligonucleotide
gagacctttgttcac

SEQ ID NO: 1629 - DNA, 15 bp, Artificial Sequence
  Description of Artificial Sequence: Synthetic oligonucleotide
ctgggaggtgggggg

SEQ ID NO: 1630 - DNA, 15 bp, Artificial Sequence
  Description of Artificial Sequence: Synthetic oligonucleotide
ggagcgcctctgccc

SEQ ID NO: 1631 - DNA, 15 bp, Artificial Sequence
  Description of Artificial Sequence: Synthetic oligonucleotide
acacaaacactgcgg

SEQ ID NO: 1632 - DNA, 15 bp, Artificial Sequence
  Description of Artificial Sequence: Synthetic oligonucleotide
caagaattatcaata

SEQ ID NO: 1633 - DNA, 15 bp, Artificial Sequence
  Description of Artificial Sequence: Synthetic oligonucleotide
gccggattgcagcct

SEQ ID NO: 1634 - DNA, 15 bp, Artificial Sequence
  Description of Artificial Sequence: Synthetic oligonucleotide
acggagtctggttca

SEQ ID NO: 1635 - DNA, 15 bp, Artificial Sequence
  Description of Artificial Sequence: Synthetic oligonucleotide
caagtacccagggac

SEQ ID NO: 1636 - DNA, 15 bp, Artificial Sequence
  Description of Artificial Sequence: Synthetic oligonucleotide
ttgcccaggctggag

SEQ ID NO: 1637 - DNA, 15 bp, Artificial Sequence
  Description of Artificial Sequence: Synthetic oligonucleotide
ccgaggctggactgt

SEQ ID NO: 1638 - DNA, 15 bp, Artificial Sequence
  Description of Artificial Sequence: Synthetic oligonucleotide
ggctccagtgattct

SEQ ID NO: 1639 - DNA, 15 bp, Artificial Sequence
  Description of Artificial Sequence: Synthetic oligonucleotide
cctgactggtttttg

SEQ ID NO: 1640 - DNA, 15 bp, Artificial Sequence
  Description of Artificial Sequence: Synthetic oligonucleotide
attatcctatgaccc

SEQ ID NO: 1641 - DNA, 15 bp, Artificial Sequence
  Description of Artificial Sequence: Synthetic oligonucleotide
ggtgtgcccaacagc

SEQ ID NO: 1642 - DNA, 15 bp, Artificial Sequence
  Description of Artificial Sequence: Synthetic oligonucleotide
cagctcattgagaac

SEQ ID NO: 1643 - DNA, 15 bp, Artificial Sequence
  Description of Artificial Sequence: Synthetic oligonucleotide
caaagagccggattg

SEQ ID NO: 1644 - DNA, 15 bp, Artificial Sequence
  Description of Artificial Sequence: Synthetic oligonucleotide
ctctttccacggtct

SEQ ID NO: 1645 - DNA, 15 bp, Artificial Sequence
  Description of Artificial Sequence: Synthetic oligonucleotide
gccgcctgccttggc

SEQ ID NO: 1646 - DNA, 15 bp, Artificial Sequence
  Description of Artificial Sequence: Synthetic oligonucleotide
ctgtcccctctttcc

SEQ ID NO: 1647 - DNA, 15 bp, Artificial Sequence
  Description of Artificial Sequence: Synthetic oligonucleotide
gcctctgcccggccg

SEQ ID NO: 1648 - DNA, 15 bp, Artificial Sequence
  Description of Artificial Sequence: Synthetic oligonucleotide
actggtttttgtatt

SEQ ID NO: 1649 - DNA, 15 bp, Artificial Sequence
  Description of Artificial Sequence: Synthetic oligonucleotide
cccaaccctgtgctc

SEQ ID NO: 1650 - DNA, 15 bp, Artificial Sequence
  Description of Artificial Sequence: Synthetic oligonucleotide
tgttctgtactaaga

SEQ ID NO: 1651 - DNA, 15 bp, Artificial Sequence
  Description of Artificial Sequence: Synthetic oligonucleotide
ctgcccggccagccg

SEQ ID NO: 1652 - DNA, 15 bp, Artificial Sequence
  Description of Artificial Sequence: Synthetic oligonucleotide
cttacccccaacccc

SEQ ID NO: 1653 - DNA, 15 bp, Artificial Sequence
  Description of Artificial Sequence: Synthetic oligonucleotide
ccgggaggtgagggg

SEQ ID NO: 1654 - DNA, 15 bp, Artificial Sequence
  Description of Artificial Sequence: Synthetic oligonucleotide
aatagaaaggcggga

SEQ ID NO: 1655 - DNA, 15 bp, Artificial Sequence
  Description of Artificial Sequence: Synthetic oligonucleotide
ctgccttgggatgct

SEQ ID NO: 1656 - DNA, 15 bp, Artificial Sequence
  Description of Artificial Sequence: Synthetic oligonucleotide
aggagcccctctgcc

SEQ ID NO: 1657 - DNA, 15 bp, Artificial Sequence
  Description of Artificial Sequence: Synthetic oligonucleotide
atgtgaggagcccct

SEQ ID NO: 1658 - DNA, 15 bp, Artificial Sequence
  Description of Artificial Sequence: Synthetic oligonucleotide
ctgttgatctgtgac

SEQ ID NO: 1659 - DNA, 15 bp, Artificial Sequence
  Description of Artificial Sequence: Synthetic oligonucleotide
agtctcgttcactca

SEQ ID NO: 1660 - DNA, 15 bp, Artificial Sequence
  Description of Artificial Sequence: Synthetic oligonucleotide
tcccgaggtgccggg

SEQ ID NO: 1661 - DNA, 15 bp, Artificial Sequence
  Description of Artificial Sequence: Synthetic oligonucleotide
gtggagacggggttt

SEQ ID NO: 1662 - DNA, 15 bp, Artificial Sequence
  Description of Artificial Sequence: Synthetic oligonucleotide
ttttgtcgaatagaa

SEQ ID NO: 1663 - DNA, 15 bp, Artificial Sequence
  Description of Artificial Sequence: Synthetic oligonucleotide
gaattatcaataaaa

SEQ ID NO: 1664 - DNA, 15 bp, Artificial Sequence
  Description of Artificial Sequence: Synthetic oligonucleotide
atggttgccgtgtct

SEQ ID NO: 1665 - DNA, 15 bp, Artificial Sequence
  Description of Artificial Sequence: Synthetic oligonucleotide
ctctctccacggtct

SEQ ID NO: 1666 - DNA, 15 bp, Artificial Sequence
  Description of Artificial Sequence: Synthetic oligonucleotide
acggtactgctgcca

SEQ ID NO: 1667 - DNA, 15 bp, Artificial Sequence
  Description of Artificial Sequence: Synthetic oligonucleotide
cacggtctccctctg

SEQ ID NO: 1668 - DNA, 15 bp, Artificial Sequence
  Description of Artificial Sequence: Synthetic oligonucleotide
gtgttggccgggctg

SEQ ID NO: 1669 - DNA, 15 bp, Artificial Sequence
  Description of Artificial Sequence: Synthetic oligonucleotide
gtagaaagaagtaga

SEQ ID NO: 1670 - DNA, 15 bp, Artificial Sequence
  Description of Artificial Sequence: Synthetic oligonucleotide
tctccacggtctccc

SEQ ID NO: 1671 - DNA, 15 bp, Artificial Sequence
  Description of Artificial Sequence: Synthetic oligonucleotide
ccattttgttctgta

SEQ ID NO: 1672 - DNA, 15 bp, Artificial Sequence
  Description of Artificial Sequence: Synthetic oligonucleotide
acccaagaatgatca

SEQ ID NO: 1673 - DNA, 15 bp, Artificial Sequence
  Description of Artificial Sequence: Synthetic oligonucleotide
ctctccctctcccct

SEQ ID NO: 1674 - DNA, 15 bp, Artificial Sequence
  Description of Artificial Sequence: Synthetic oligonucleotide
agcctcggcctcccg

SEQ ID NO: 1675 - DNA, 15 bp, Artificial Sequence
  Description of Artificial Sequence: Synthetic oligonucleotide
catcgtctgggatgt

SEQ ID NO: 1676 - DNA, 15 bp, Artificial Sequence
  Description of Artificial Sequence: Synthetic oligonucleotide
cggccgccccgtctg

SEQ ID NO: 1677 - DNA, 15 bp, Artificial Sequence
  Description of Artificial Sequence: Synthetic oligonucleotide
aaacacccaagaatg

SEQ ID NO: 1678 - DNA, 15 bp, Artificial Sequence
  Description of Artificial Sequence: Synthetic oligonucleotide
tcccatgaccctgcc

SEQ ID NO: 1679 - DNA, 15 bp, Artificial Sequence
  Description of Artificial Sequence: Synthetic oligonucleotide
gccgccatcccgtct

SEQ ID NO: 1680 - DNA, 15 bp, Artificial Sequence
  Description of Artificial Sequence: Synthetic oligonucleotide
ttcacgtgtttatct

SEQ ID NO: 1681 - DNA, 15 bp, Artificial Sequence
  Description of Artificial Sequence: Synthetic oligonucleotide
atcccgtctaggaag

SEQ ID NO: 1682 - DNA, 15 bp, Artificial Sequence
  Description of Artificial Sequence: Synthetic oligonucleotide
ggcggttttgtggaa

SEQ ID NO: 1683 - DNA, 15 bp, Artificial Sequence
  Description of Artificial Sequence: Synthetic oligonucleotide
tcatgcggagccgaa

SEQ ID NO: 1684 - DNA, 15 bp, Artificial Sequence
  Description of Artificial Sequence: Synthetic oligonucleotide
gtcagccccccgccc

SEQ ID NO: 1685 - DNA, 15 bp, Artificial Sequence
  Description of Artificial Sequence: Synthetic oligonucleotide
tggttgccgggtctg

SEQ ID NO: 1686 - DNA, 15 bp, Artificial Sequence
  Description of Artificial Sequence: Synthetic oligonucleotide
ctgctgaccttctct

SEQ ID NO: 1687 - DNA, 15 bp, Artificial Sequence
  Description of Artificial Sequence: Synthetic oligonucleotide
ggctcgctacaacca

SEQ ID NO: 1688 - DNA, 15 bp, Artificial Sequence
  Description of Artificial Sequence: Synthetic oligonucleotide
tgagaaacacccaag

SEQ ID NO: 1689 - DNA, 15 bp, Artificial Sequence
  Description of Artificial Sequence: Synthetic oligonucleotide
gcacctctgccccgc

SEQ ID NO: 1690 - DNA, 15 bp, Artificial Sequence
  Description of Artificial Sequence: Synthetic oligonucleotide
tctcgctcactcagt

SEQ ID NO: 1691 - DNA, 15 bp, Artificial Sequence
  Description of Artificial Sequence: Synthetic oligonucleotide
cccggccgccacccc

SEQ ID NO: 1692 - DNA, 15 bp, Artificial Sequence
  Description of Artificial Sequence: Synthetic oligonucleotide
aatctcaagtaatca

SEQ ID NO: 1693 - DNA, 15 bp, Artificial Sequence
  Description of Artificial Sequence: Synthetic oligonucleotide
ggctcgctacaacct

SEQ ID NO: 1694 - DNA, 15 bp, Artificial Sequence
  Description of Artificial Sequence: Synthetic oligonucleotide
aggcacgcgccgcca

SEQ ID NO: 1695 - DNA, 15 bp, Artificial Sequence
  Description of Artificial Sequence: Synthetic oligonucleotide
ctgtactgctgccat

SEQ ID NO: 1696 - DNA, 15 bp, Artificial Sequence
  Description of Artificial Sequence: Synthetic oligonucleotide
ggcggtgcaagatgt

SEQ ID NO: 1697 - DNA, 15 bp, Artificial Sequence
  Description of Artificial Sequence: Synthetic oligonucleotide
ctactgggaagtgag

SEQ ID NO: 1698 - DNA, 15 bp, Artificial Sequence
  Description of Artificial Sequence: Synthetic oligonucleotide
gggttaaatggatta

SEQ ID NO: 1699 - DNA, 15 bp, Artificial Sequence
  Description of Artificial Sequence: Synthetic oligonucleotide
ctcggctcactgcaa

SEQ ID NO: 1700 - DNA, 15 bp, Artificial Sequence
  Description of Artificial Sequence: Synthetic oligonucleotide
ttttcgtattttttt

SEQ ID NO: 1701 - DNA, 15 bp, Artificial Sequence
  Description of Artificial Sequence: Synthetic oligonucleotide
ttgttcacttgttta

SEQ ID NO: 1702 - DNA, 15 bp, Artificial Sequence
  Description of Artificial Sequence: Synthetic oligonucleotide
caccgccccgtctgg

SEQ ID NO: 1703 - DNA, 15 bp, Artificial Sequence
  Description of Artificial Sequence: Synthetic oligonucleotide
tgccgagccaaagct

SEQ ID NO: 1704 - DNA, 15 bp, Artificial Sequence
  Description of Artificial Sequence: Synthetic oligonucleotide
tcgctcactcagtgc

SEQ ID NO: 1705 - DNA, 15 bp, Artificial Sequence
  Description of Artificial Sequence: Synthetic oligonucleotide
caataaaaaaaatta

SEQ ID NO: 1706 - DNA, 15 bp, Artificial Sequence
  Description of Artificial Sequence: Synthetic oligonucleotide
tcccctctttctacg

SEQ ID NO: 1707 - DNA, 15 bp, Artificial Sequence
  Description of Artificial Sequence: Synthetic oligonucleotide
atgaccctgccacat

SEQ ID NO: 1708 - DNA, 15 bp, Artificial Sequence
  Description of Artificial Sequence: Synthetic oligonucleotide
ccgccaccccgtctg

SEQ ID NO: 1709 - DNA, 15 bp, Artificial Sequence
  Description of Artificial Sequence: Synthetic oligonucleotide
gggctggtctccagc

SEQ ID NO: 1710 - DNA, 15 bp, Artificial Sequence
  Description of Artificial Sequence: Synthetic oligonucleotide
tgccaaatccccctc

SEQ ID NO: 1711 - DNA, 15 bp, Artificial Sequence
  Description of Artificial Sequence: Synthetic oligonucleotide
actccctaatctcaa

SEQ ID NO: 1712 - DNA, 15 bp, Artificial Sequence
  Description of Artificial Sequence: Synthetic oligonucleotide
cgcccatcgtctgag

SEQ ID NO: 1713 - DNA, 15 bp, Artificial Sequence
  Description of Artificial Sequence: Synthetic oligonucleotide
caccccgtctgggag

SEQ ID NO: 1714 - DNA, 15 bp, Artificial Sequence
  Description of Artificial Sequence: Synthetic oligonucleotide
agatagagaaatcgg

SEQ ID NO: 1715 - DNA, 15 bp, Artificial Sequence
  Description of Artificial Sequence: Synthetic oligonucleotide
agagaaatcggattg

SEQ ID NO: 1716 - DNA, 15 bp, Artificial Sequence
  Description of Artificial Sequence: Synthetic oligonucleotide
tccctccactattgt

SEQ ID NO: 1717 - DNA, 15 bp, Artificial Sequence
  Description of Artificial Sequence: Synthetic oligonucleotide
aattgagaaatcgga

SEQ ID NO: 1718 - DNA, 15 bp, Artificial Sequence
  Description of Artificial Sequence: Synthetic oligonucleotide
cccatgaccctgcca

SEQ ID NO: 1719 - DNA, 15 bp, Artificial Sequence
  Description of Artificial Sequence: Synthetic oligonucleotide
tgcaagatgtgcttt

SEQ ID NO: 1720 - DNA, 15 bp, Artificial Sequence
  Description of Artificial Sequence: Synthetic oligonucleotide
tacccagcgaccatt

SEQ ID NO: 1721 - DNA, 15 bp, Artificial Sequence
  Description of Artificial Sequence: Synthetic oligonucleotide
gttgctgtgtctgtg

SEQ ID NO: 1722 - DNA, 15 bp, Artificial Sequence
  Description of Artificial Sequence: Synthetic oligonucleotide
agggacctctgccta

SEQ ID NO: 1723 - DNA, 15 bp, Artificial Sequence
  Description of Artificial Sequence: Synthetic oligonucleotide
aggtgctgggattgc

SEQ ID NO: 1724 - DNA, 15 bp, Artificial Sequence
  Description of Artificial Sequence: Synthetic oligonucleotide
tctgggaggtggggg

SEQ ID NO: 1725 - DNA, 15 bp, Artificial Sequence
  Description of Artificial Sequence: Synthetic oligonucleotide
ctgggaggtgtgccc

SEQ ID NO: 1726 - DNA, 15 bp, Artificial Sequence
  Description of Artificial Sequence: Synthetic oligonucleotide
gttcacatgtttatc

SEQ ID NO: 1727 - DNA, 15 bp, Artificial Sequence
  Description of Artificial Sequence: Synthetic oligonucleotide
caaagtgccgagatt

SEQ ID NO: 1728 - DNA, 15 bp, Artificial Sequence
  Description of Artificial Sequence: Synthetic oligonucleotide
tctgagatgtgggga

SEQ ID NO: 1729 - DNA, 15 bp, Artificial Sequence
  Description of Artificial Sequence: Synthetic oligonucleotide
tgggattgcaggcac

SEQ ID NO: 1730 - DNA, 15 bp, Artificial Sequence
  Description of Artificial Sequence: Synthetic oligonucleotide
ctgccgtgatctcgg

SEQ ID NO: 1731 - DNA, 15 bp, Artificial Sequence
  Description of Artificial Sequence: Synthetic oligonucleotide
aatggcggttttgtg

SEQ ID NO: 1732 - DNA, 15 bp, Artificial Sequence
  Description of Artificial Sequence: Synthetic oligonucleotide
tgaccctgccaaatc

SEQ ID NO: 1733 - DNA, 15 bp, Artificial Sequence
  Description of Artificial Sequence: Synthetic oligonucleotide
tgatcaataaatact

SEQ ID NO: 1734 - DNA, 15 bp, Artificial Sequence
  Description of Artificial Sequence: Synthetic oligonucleotide
agtgccgagattgca

SEQ ID NO: 1735 - DNA, 15 bp, Artificial Sequence
  Description of Artificial Sequence: Synthetic oligonucleotide
aggccgcagggacct

SEQ ID NO: 1736 - DNA, 15 bp, Artificial Sequence
  Description of Artificial Sequence: Synthetic oligonucleotide
cctctgcctaggaaa

SEQ ID NO: 1737 - DNA, 15 bp, Artificial Sequence
  Description of Artificial Sequence: Synthetic oligonucleotide
gcccctctgcccggc

SEQ ID NO: 1738 - DNA, 15 bp, Artificial Sequence
  Description of Artificial Sequence: Synthetic oligonucleotide
tctgggaggtgaggg

SEQ ID NO: 1739 - DNA, 15 bp, Artificial Sequence
  Description of Artificial Sequence: Synthetic oligonucleotide
tcattttgttctgta

SEQ ID NO: 1740 - DNA, 15 bp, Artificial Sequence
  Description of Artificial Sequence: Synthetic oligonucleotide
cgcctcggcctcccg

SEQ ID NO: 1741 - DNA, 15 bp, Artificial Sequence
  Description of Artificial Sequence: Synthetic oligonucleotide
taagggcggtgcaag

SEQ ID NO: 1742 - DNA, 15 bp, Artificial Sequence
  Description of Artificial Sequence: Synthetic oligonucleotide
ccaagaatgatcaat

SEQ ID NO: 1743 - DNA, 15 bp, Artificial Sequence
  Description of Artificial Sequence: Synthetic oligonucleotide
gaccgggctggtctc

SEQ ID NO: 1744 - DNA, 15 bp, Artificial Sequence
  Description of Artificial Sequence: Synthetic oligonucleotide
gctgttaatctataa

SEQ ID NO: 1745 - DNA, 15 bp, Artificial Sequence
  Description of Artificial Sequence: Synthetic oligonucleotide
cttctgggaagtgag

SEQ ID NO: 1746 - DNA, 15 bp, Artificial Sequence
  Description of Artificial Sequence: Synthetic oligonucleotide
agaaaggcgggaaag

SEQ ID NO: 1747 - DNA, 15 bp, Artificial Sequence
  Description of Artificial Sequence: Synthetic oligonucleotide
agtctcgctcactca

SEQ ID NO: 1748 - DNA, 15 bp, Artificial Sequence
  Description of Artificial Sequence: Synthetic oligonucleotide
gtctaggaagtgagg

SEQ ID NO: 1749 - DNA, 15 bp, Artificial Sequence
  Description of Artificial Sequence: Synthetic oligonucleotide
tgggattgcagacgg

SEQ ID NO: 1750 - DNA, 15 bp, Artificial Sequence
  Description of Artificial Sequence: Synthetic oligonucleotide
agagtcatcaccact

SEQ ID NO: 1751 - DNA, 15 bp, Artificial Sequence
  Description of Artificial Sequence: Synthetic oligonucleotide
gatgctgttgatctg

SEQ ID NO: 1752 - DNA, 15 bp, Artificial Sequence
  Description of Artificial Sequence: Synthetic oligonucleotide
ccccgccgccccgtc

SEQ ID NO: 1753 - DNA, 15 bp, Artificial Sequence
  Description of Artificial Sequence: Synthetic oligonucleotide
gggccatgatgacga

SEQ ID NO: 1754 - DNA, 15 bp, Artificial Sequence
  Description of Artificial Sequence: Synthetic oligonucleotide
aagctggactgtact

SEQ ID NO: 1755 - DNA, 15 bp, Artificial Sequence
  Description of Artificial Sequence: Synthetic oligonucleotide
gcagacggagtctcg

SEQ ID NO: 1756 - DNA, 15 bp, Artificial Sequence
  Description of Artificial Sequence: Synthetic oligonucleotide
tctgcccggccgcca

SEQ ID NO: 1757 - DNA, 15 bp, Artificial Sequence
  Description of Artificial Sequence: Synthetic oligonucleotide
tctgcccggccgccc

SEQ ID NO: 1758 - DNA, 15 bp, Artificial Sequence
  Description of Artificial Sequence: Synthetic oligonucleotide
ggatgtgaggagccc

SEQ ID NO: 1759 - DNA, 15 bp, Artificial Sequence
  Description of Artificial Sequence: Synthetic oligonucleotide
gggaagtgaggagcg

SEQ ID NO: 1760 - DNA, 15 bp, Artificial Sequence
  Description of Artificial Sequence: Synthetic oligonucleotide
gggaagtgaggagcc

SEQ ID NO: 1761 - DNA, 15 bp, Artificial Sequence
  Description of Artificial Sequence: Synthetic oligonucleotide
tccacctcccagccg

SEQ ID NO: 1762 - DNA, 15 bp, Artificial Sequence
  Description of Artificial Sequence: Synthetic oligonucleotide
gtggggaaaagatag

SEQ ID NO: 1763 - DNA, 15 bp, Artificial Sequence
  Description of Artificial Sequence: Synthetic oligonucleotide
ctaagattgcagcct

SEQ ID NO: 1764 - DNA, 15 bp, Artificial Sequence
  Description of Artificial Sequence: Synthetic oligonucleotide
tgaaggcagcatgct

SEQ ID NO: 1765 - DNA, 15 bp, Artificial Sequence
  Description of Artificial Sequence: Synthetic oligonucleotide
gctggactgtactgc

SEQ ID NO: 1766 - DNA, 15 bp, Artificial Sequence
  Description of Artificial Sequence: Synthetic oligonucleotide
cactgcggaaggccg

SEQ ID NO: 1767 - DNA, 15 bp, Artificial Sequence
  Description of Artificial Sequence: Synthetic oligonucleotide
gaggagcgcctcttc

SEQ ID NO: 1768 - DNA, 15 bp, Artificial Sequence
  Description of Artificial Sequence: Synthetic oligonucleotide
tcgaaaagaaaaggg

SEQ ID NO: 1769 - DNA, 15 bp, Artificial Sequence
  Description of Artificial Sequence: Synthetic oligonucleotide
tttgttaaacagatg

SEQ ID NO: 1770 - DNA, 15 bp, Artificial Sequence
  Description of Artificial Sequence: Synthetic oligonucleotide
ctgactggttttggt

SEQ ID NO: 1771 - DNA, 15 bp, Artificial Sequence
  Description of Artificial Sequence: Synthetic oligonucleotide
ttgcaggcacgcgcc

SEQ ID NO: 1772 - DNA, 15 bp, Artificial Sequence
  Description of Artificial Sequence: Synthetic oligonucleotide
tctgttgccgaggct

SEQ ID NO: 1773 - DNA, 15 bp, Artificial Sequence
  Description of Artificial Sequence: Synthetic oligonucleotide
agagagatcagattg

SEQ ID NO: 1774 - DNA, 15 bp, Artificial Sequence
  Description of Artificial Sequence: Synthetic oligonucleotide
ctcggcctcccgagg

SEQ ID NO: 1775 - DNA, 15 bp, Artificial Sequence
  Description of Artificial Sequence: Synthetic oligonucleotide
tggcgtgatctcggc

SEQ ID NO: 1776 - DNA, 15 bp, Artificial Sequence
  Description of Artificial Sequence: Synthetic oligonucleotide
gcctccgcccggccg

SEQ ID NO: 1777 - DNA, 15 bp, Artificial Sequence
  Description of Artificial Sequence: Synthetic oligonucleotide
tctccctctccctct

SEQ ID NO: 1778 - DNA, 15 bp, Artificial Sequence
  Description of Artificial Sequence: Synthetic oligonucleotide
tcagggttaaatgga

SEQ ID NO: 1779 - DNA, 15 bp, Artificial Sequence
  Description of Artificial Sequence: Synthetic oligonucleotide
ctgtgagaaacaccc

SEQ ID NO: 1780 - DNA, 15 bp, Artificial Sequence
  Description of Artificial Sequence: Synthetic oligonucleotide
ccgagtgcctgcgat

SEQ ID NO: 1781 - DNA, 15 bp, Artificial Sequence
  Description of Artificial Sequence: Synthetic oligonucleotide
ccctccactattgtc

SEQ ID NO: 1782 - DNA, 15 bp, Artificial Sequence
  Description of Artificial Sequence: Synthetic oligonucleotide
cctctcccctctttc

SEQ ID NO: 1783 - DNA, 15 bp, Artificial Sequence
  Description of Artificial Sequence: Synthetic oligonucleotide
caatggcggctttgt

SEQ ID NO: 1784 - DNA, 15 bp, Artificial Sequence
  Description of Artificial Sequence: Synthetic oligonucleotide
cgcctctgcccggcc

SEQ ID NO: 1785 - DNA, 15 bp, Artificial Sequence
  Description of Artificial Sequence: Synthetic oligonucleotide
gaaacatgtgctgtg

SEQ ID NO: 1786 - DNA, 15 bp, Artificial Sequence
  Description of Artificial Sequence: Synthetic oligonucleotide
cccccaaccctgtgc

SEQ ID NO: 1787 - DNA, 15 bp, Artificial Sequence
  Description of Artificial Sequence: Synthetic oligonucleotide
gagtctcgctcactc

SEQ ID NO: 1788 - DNA, 15 bp, Artificial Sequence
  Description of Artificial Sequence: Synthetic oligonucleotide
tggtggagacggggt

SEQ ID NO: 1789 - DNA, 15 bp, Artificial Sequence
  Description of Artificial Sequence: Synthetic oligonucleotide
ggtctccctctgttg

SEQ ID NO: 1790 - DNA, 15 bp, Artificial Sequence
  Description of Artificial Sequence: Synthetic oligonucleotide
aaacactgcggaagg

SEQ ID NO: 1791 - DNA, 15 bp, Artificial Sequence
  Description of Artificial Sequence: Synthetic oligonucleotide
ggccgccatcccgtc

SEQ ID NO: 1792 - DNA, 15 bp, Artificial Sequence
  Description of Artificial Sequence: Synthetic oligonucleotide
cagacggagtctcgt

SEQ ID NO: 1793 - DNA, 15 bp, Artificial Sequence
  Description of Artificial Sequence: Synthetic oligonucleotide
gctcattggggatgg

SEQ ID NO: 1794 - DNA, 15 bp, Artificial Sequence
  Description of Artificial Sequence: Synthetic oligonucleotide
catcaccactcccta

SEQ ID NO: 1795 - DNA, 15 bp, Artificial Sequence
  Description of Artificial Sequence: Synthetic oligonucleotide
tctccctctcccctc

SEQ ID NO: 1796 - DNA, 15 bp, Artificial Sequence
  Description of Artificial Sequence: Synthetic oligonucleotide
cagacggagtctcgc

SEQ ID NO: 1797 - DNA, 15 bp, Artificial Sequence
  Description of Artificial Sequence: Synthetic oligonucleotide
aagggtggggaaaaa

SEQ ID NO: 1798 - DNA, 15 bp, Artificial Sequence
  Description of Artificial Sequence: Synthetic oligonucleotide
ttctgggaagtgagg

SEQ ID NO: 1799 - DNA, 15 bp, Artificial Sequence
  Description of Artificial Sequence: Synthetic oligonucleotide
cctgccacatccccc

SEQ ID NO: 1800 - DNA, 15 bp, Artificial Sequence
  Description of Artificial Sequence: Synthetic oligonucleotide
ctgcccagtctggga

SEQ ID NO: 1801 - DNA, 15 bp, Artificial Sequence
  Description of Artificial Sequence: Synthetic oligonucleotide
accttacccccaacc

SEQ ID NO: 1802 - DNA, 15 bp, Artificial Sequence
  Description of Artificial Sequence: Synthetic oligonucleotide
cgccatcccgtctgg

SEQ ID NO: 1803 - DNA, 15 bp, Artificial Sequence
  Description of Artificial Sequence: Synthetic oligonucleotide
ctctgcccggccgcc

SEQ ID NO: 1804 - DNA, 15 bp, Artificial Sequence
  Description of Artificial Sequence: Synthetic oligonucleotide
aggaggtgggggggt

SEQ ID NO: 1805 - DNA, 15 bp, Artificial Sequence
  Description of Artificial Sequence: Synthetic oligonucleotide
ctcccgaggtgccgg

SEQ ID NO: 1806 - DNA, 15 bp, Artificial Sequence
  Description of Artificial Sequence: Synthetic oligonucleotide
cgaagctggactgta

SEQ ID NO: 1807 - DNA, 15 bp, Artificial Sequence
  Description of Artificial Sequence: Synthetic oligonucleotide
gttggccgggctggt

SEQ ID NO: 1808 - DNA, 15 bp, Artificial Sequence
  Description of Artificial Sequence: Synthetic oligonucleotide
tagaaaagggggaaa

SEQ ID NO: 1809 - DNA, 15 bp, Artificial Sequence
  Description of Artificial Sequence: Synthetic oligonucleotide
ggctggagtgcagtg

SEQ ID NO: 1810 - DNA, 15 bp, Artificial Sequence
  Description of Artificial Sequence: Synthetic oligonucleotide
ccctgcctcgggctc

SEQ ID NO: 1811 - DNA, 15 bp, Artificial Sequence
  Description of Artificial Sequence: Synthetic oligonucleotide
gtctgggatgtgggg

SEQ ID NO: 1812 - DNA, 15 bp, Artificial Sequence
  Description of Artificial Sequence: Synthetic oligonucleotide
ctgtgtcaactcagg

SEQ ID NO: 1813 - DNA, 15 bp, Artificial Sequence
  Description of Artificial Sequence: Synthetic oligonucleotide
gccgtgttggccggg

SEQ ID NO: 1814 - DNA, 15 bp, Artificial Sequence
  Description of Artificial Sequence: Synthetic oligonucleotide
cactattatcctatg

SEQ ID NO: 1815 - DNA, 15 bp, Artificial Sequence
  Description of Artificial Sequence: Synthetic oligonucleotide
cccctctccgagaaa

SEQ ID NO: 1816 - DNA, 15 bp, Artificial Sequence
  Description of Artificial Sequence: Synthetic oligonucleotide
cggctcgctacaacc

SEQ ID NO: 1817 - DNA, 15 bp, Artificial Sequence
  Description of Artificial Sequence: Synthetic oligonucleotide
gtctgggatgtgagg

SEQ ID NO: 1818 - DNA, 15 bp, Artificial Sequence
  Description of Artificial Sequence: Synthetic oligonucleotide
gacatgggagacttt

SEQ ID NO: 1819 - DNA, 15 bp, Artificial Sequence
  Description of Artificial Sequence: Synthetic oligonucleotide
cccctctttctacgg

SEQ ID NO: 1820 - DNA, 15 bp, Artificial Sequence
  Description of Artificial Sequence: Synthetic oligonucleotide
gaaggccgcagggac

SEQ ID NO: 1821 - DNA, 15 bp, Artificial Sequence
  Description of Artificial Sequence: Synthetic oligonucleotide
aggatgacaatggcg

SEQ ID NO: 1822 - DNA, 15 bp, Artificial Sequence
  Description of Artificial Sequence: Synthetic oligonucleotide
gacatgggagacttc

SEQ ID NO: 1823 - DNA, 15 bp, Artificial Sequence
  Description of Artificial Sequence: Synthetic oligonucleotide
ccaccaccccgtctg

SEQ ID NO: 1824 - DNA, 15 bp, Artificial Sequence
  Description of Artificial Sequence: Synthetic oligonucleotide
gggaggtgtgcccaa

SEQ ID NO: 1825 - DNA, 15 bp, Artificial Sequence
  Description of Artificial Sequence: Synthetic oligonucleotide
gcccgcctcggcctc

SEQ ID NO: 1826 - DNA, 15 bp, Artificial Sequence
  Description of Artificial Sequence: Synthetic oligonucleotide
gggaggtgtgcccag

SEQ ID NO: 1827 - DNA, 15 bp, Artificial Sequence
  Description of Artificial Sequence: Synthetic oligonucleotide
atctgtgaccttacc

SEQ ID NO: 1828 - DNA, 15 bp, Artificial Sequence
  Description of Artificial Sequence: Synthetic oligonucleotide
tataaccttaccccc

SEQ ID NO: 1829 - DNA, 15 bp, Artificial Sequence
  Description of Artificial Sequence: Synthetic oligonucleotide
catgctcgttaagag

SEQ ID NO: 1830 - DNA, 15 bp, Artificial Sequence
  Description of Artificial Sequence: Synthetic oligonucleotide
gcgtctctgcctggc

SEQ ID NO: 1831 - DNA, 15 bp, Artificial Sequence
  Description of Artificial Sequence: Synthetic oligonucleotide
gggtctgtgtggata

SEQ ID NO: 1832 - DNA, 15 bp, Artificial Sequence
  Description of Artificial Sequence: Synthetic oligonucleotide
cgtccgggaggtgag

SEQ ID NO: 1833 - DNA, 15 bp, Artificial Sequence
  Description of Artificial Sequence: Synthetic oligonucleotide
acggtctccctctgt

SEQ ID NO: 1834 - DNA, 15 bp, Artificial Sequence
  Description of Artificial Sequence: Synthetic oligonucleotide
atggtgcccaggctg

SEQ ID NO: 1835 - DNA, 15 bp, Artificial Sequence
  Description of Artificial Sequence: Synthetic oligonucleotide
tgggaggtgtaccca

SEQ ID NO: 1836 - DNA, 15 bp, Artificial Sequence
  Description of Artificial Sequence: Synthetic oligonucleotide
tctgcccggccagcc

SEQ ID NO: 1837 - DNA, 15 bp, Artificial Sequence
  Description of Artificial Sequence: Synthetic oligonucleotide
ccctgtcccctcttt

SEQ ID NO: 1838 - DNA, 15 bp, Artificial Sequence
  Description of Artificial Sequence: Synthetic oligonucleotide
tgaccttacccccaa

SEQ ID NO: 1839 - DNA, 15 bp, Artificial Sequence
  Description of Artificial Sequence: Synthetic oligonucleotide
acggtctccctctga

SEQ ID NO: 1840 - DNA, 15 bp, Artificial Sequence
  Description of Artificial Sequence: Synthetic oligonucleotide
cctttgttcacgtgt

SEQ ID NO: 1841 - DNA, 15 bp, Artificial Sequence
  Description of Artificial Sequence: Synthetic oligonucleotide
tgtactgctgccatc

SEQ ID NO: 1842 - DNA, 15 bp, Artificial Sequence
  Description of Artificial Sequence: Synthetic oligonucleotide
tgggattgcaggcgc

SEQ ID NO: 1843 - DNA, 15 bp, Artificial Sequence
  Description of Artificial Sequence: Synthetic oligonucleotide
cccctctgtgagaaa

SEQ ID NO: 1844 - DNA, 15 bp, Artificial Sequence
  Description of Artificial Sequence: Synthetic oligonucleotide
tttggtggagacggg

SEQ ID NO: 1845 - DNA, 15 bp, Artificial Sequence
  Description of Artificial Sequence: Synthetic oligonucleotide
aacctccctgcctcg

SEQ ID NO: 1846 - DNA, 15 bp, Artificial Sequence
  Description of Artificial Sequence: Synthetic oligonucleotide
cctgactggttttgg

SEQ ID NO: 1847 - DNA, 15 bp, Artificial Sequence
  Description of Artificial Sequence: Synthetic oligonucleotide
ccacggtctccctct

SEQ ID NO: 1848 - DNA, 15 bp, Artificial Sequence
  Description of Artificial Sequence: Synthetic oligonucleotide
gcggctcattgggga

SEQ ID NO: 1849 - DNA, 15 bp, Artificial Sequence
  Description of Artificial Sequence: Synthetic oligonucleotide
acttcattttgttct

SEQ ID NO: 1850 - DNA, 15 bp, Artificial Sequence
  Description of Artificial Sequence: Synthetic oligonucleotide
cctccctgcctcggg

SEQ ID NO: 1851 - DNA, 15 bp, Artificial Sequence
  Description of Artificial Sequence: Synthetic oligonucleotide
gggattgcaggcacg

SEQ ID NO: 1852 - DNA, 15 bp, Artificial Sequence
  Description of Artificial Sequence: Synthetic oligonucleotide
tgtcctatgaccctg

SEQ ID NO: 1853 - DNA, 15 bp, Artificial Sequence
  Description of Artificial Sequence: Synthetic oligonucleotide
gcccagtctgggaag

SEQ ID NO: 1854 - DNA, 15 bp, Artificial Sequence
  Description of Artificial Sequence: Synthetic oligonucleotide
cgtctgggaggtggg

SEQ ID NO: 1855 - DNA, 15 bp, Artificial Sequence
  Description of Artificial Sequence: Synthetic oligonucleotide
tcttaagtacccagg

SEQ ID NO: 1856 - DNA, 15 bp, Artificial Sequence
  Description of Artificial Sequence: Synthetic oligonucleotide
agaaagaggtagaca

SEQ ID NO: 1857 - DNA, 15 bp, Artificial Sequence
  Description of Artificial Sequence: Synthetic oligonucleotide
tgttgaccgggctgg

SEQ ID NO: 1858 - DNA, 15 bp, Artificial Sequence
  Description of Artificial Sequence: Synthetic oligonucleotide
cagccgcctgccttg

SEQ ID NO: 1859 - DNA, 15 bp, Artificial Sequence
  Description of Artificial Sequence: Synthetic oligonucleotide
ataaatactaaaaaa

SEQ ID NO: 1860 - DNA, 15 bp, Artificial Sequence
  Description of Artificial Sequence: Synthetic oligonucleotide
ccaaccccgtgctct

SEQ ID NO: 1861 - DNA, 15 bp, Artificial Sequence
  Description of Artificial Sequence: Synthetic oligonucleotide
gatctgcccgcctcg

SEQ ID NO: 1862 - DNA, 15 bp, Artificial Sequence
  Description of Artificial Sequence: Synthetic oligonucleotide
ttgttcacgtgttta

SEQ ID NO: 1863 - DNA, 15 bp, Artificial Sequence
  Description of Artificial Sequence: Synthetic oligonucleotide
tgcggaaggccgcag

SEQ ID NO: 1864 - DNA, 15 bp, Artificial Sequence
  Description of Artificial Sequence: Synthetic oligonucleotide
ggcggttttgtcgaa

SEQ ID NO: 1865 - DNA, 15 bp, Artificial Sequence
  Description of Artificial Sequence: Synthetic oligonucleotide
tcagattgttactgt

SEQ ID NO: 1866 - DNA, 15 bp, Artificial Sequence
  Description of Artificial Sequence: Synthetic oligonucleotide
tgcccggccagccgc

SEQ ID NO: 1867 - DNA, 15 bp, Artificial Sequence
  Description of Artificial Sequence: Synthetic oligonucleotide
actggttttggtgga

SEQ ID NO: 1868 - DNA, 15 bp, Artificial Sequence
  Description of Artificial Sequence: Synthetic oligonucleotide
tgccttggcctccca

SEQ ID NO: 1869 - DNA, 15 bp, Artificial Sequence
  Description of Artificial Sequence: Synthetic oligonucleotide
gaatgatcaataaaa

SEQ ID NO: 1870 - DNA, 15 bp, Artificial Sequence
  Description of Artificial Sequence: Synthetic oligonucleotide
cagagacctttgttc

SEQ ID NO: 1871 - DNA, 15 bp, Artificial Sequence
  Description of Artificial Sequence: Synthetic oligonucleotide
gaaagagagatcaga

SEQ ID NO: 1872 - DNA, 15 bp, Artificial Sequence
  Description of Artificial Sequence: Synthetic oligonucleotide
gaatgatcaataaat

SEQ ID NO: 1873 - DNA, 15 bp, Artificial Sequence
  Description of Artificial Sequence: Synthetic oligonucleotide
aattatcaataaaaa

SEQ ID NO: 1874 - DNA, 15 bp, Artificial Sequence
  Description of Artificial Sequence: Synthetic oligonucleotide
ccgggattgcagacg

SEQ ID NO: 1875 - DNA, 15 bp, Artificial Sequence
  Description of Artificial Sequence: Synthetic oligonucleotide
ggttgccgtgtctgt

SEQ ID NO: 1876 - DNA, 15 bp, Artificial Sequence
  Description of Artificial Sequence: Synthetic oligonucleotide
agacggagtctcgtt

SEQ ID NO: 1877 - DNA, 15 bp, Artificial Sequence
  Description of Artificial Sequence: Synthetic oligonucleotide
tgcttgaaggcagca

SEQ ID NO: 1878 - DNA, 15 bp, Artificial Sequence
  Description of Artificial Sequence: Synthetic oligonucleotide
atagaaaagggggaa

SEQ ID NO: 1879 - DNA, 15 bp, Artificial Sequence
  Description of Artificial Sequence: Synthetic oligonucleotide
aaagaggtagacatg

SEQ ID NO: 1880 - DNA, 15 bp, Artificial Sequence
  Description of Artificial Sequence: Synthetic oligonucleotide
gttcacttgtttatc

SEQ ID NO: 1881 - DNA, 15 bp, Artificial Sequence
  Description of Artificial Sequence: Synthetic oligonucleotide
gtgtgcccagcggct

SEQ ID NO: 1882 - DNA, 15 bp, Artificial Sequence
  Description of Artificial Sequence: Synthetic oligonucleotide
tcgccgtgttggccg

SEQ ID NO: 1883 - DNA, 15 bp, Artificial Sequence
  Description of Artificial Sequence: Synthetic oligonucleotide
tcctgcctcggcctg

SEQ ID NO: 1884 - DNA, 15 bp, Artificial Sequence
  Description of Artificial Sequence: Synthetic oligonucleotide
cgttcactcagtgct

SEQ ID NO: 1885 - DNA, 15 bp, Artificial Sequence
  Description of Artificial Sequence: Synthetic oligonucleotide
gggtcagccccccgc

SEQ ID NO: 1886 - DNA, 15 bp, Artificial Sequence
  Description of Artificial Sequence: Synthetic oligonucleotide
ttgtattttttggtg

SEQ ID NO: 1887 - DNA, 15 bp, Artificial Sequence
  Description of Artificial Sequence: Synthetic oligonucleotide
tgccgagtgcctggg

SEQ ID NO: 1888 - DNA, 15 bp, Artificial Sequence
  Description of Artificial Sequence: Synthetic oligonucleotide
ttggggatgggccat

SEQ ID NO: 1889 - DNA, 15 bp, Artificial Sequence
  Description of Artificial Sequence: Synthetic oligonucleotide
aaaaaattaaaaaaa

SEQ ID NO: 1890 - DNA, 15 bp, Artificial Sequence
  Description of Artificial Sequence: Synthetic oligonucleotide
ttttgtggaatagaa

SEQ ID NO: 1891 - DNA, 15 bp, Artificial Sequence
  Description of Artificial Sequence: Synthetic oligonucleotide
ggggggtcagccccc

SEQ ID NO: 1892 - DNA, 15 bp, Artificial Sequence
  Description of Artificial Sequence: Synthetic oligonucleotide
cctgcctcggcctgc

SEQ ID NO: 1893 - DNA, 15 bp, Artificial Sequence
  Description of Artificial Sequence: Synthetic oligonucleotide
atgccgagccaaagc

SEQ ID NO: 1894 - DNA, 15 bp, Artificial Sequence
  Description of Artificial Sequence: Synthetic oligonucleotide
cctgaccgcgagtga

SEQ ID NO: 1895 - DNA, 15 bp, Artificial Sequence
  Description of Artificial Sequence: Synthetic oligonucleotide
ctataaccttacccc

SEQ ID NO: 1896 - DNA, 15 bp, Artificial Sequence
  Description of Artificial Sequence: Synthetic oligonucleotide
aatccccctctccga

SEQ ID NO: 1897 - DNA, 15 bp, Artificial Sequence
  Description of Artificial Sequence: Synthetic oligonucleotide
cctcccgaggtgccg

SEQ ID NO: 1898 - DNA, 15 bp, Artificial Sequence
  Description of Artificial Sequence: Synthetic oligonucleotide
caaagctggacggta

SEQ ID NO: 1899 - DNA, 15 bp, Artificial Sequence
  Description of Artificial Sequence: Synthetic oligonucleotide
gggagcacctctgcc

SEQ ID NO: 1900 - DNA, 15 bp, Artificial Sequence
  Description of Artificial Sequence: Synthetic oligonucleotide
ccacgcctgactggt

SEQ ID NO: 1901 - DNA, 15 bp, Artificial Sequence
  Description of Artificial Sequence: Synthetic oligonucleotide
tggactgtactgccg

SEQ ID NO: 1902 - DNA, 15 bp, Artificial Sequence
  Description of Artificial Sequence: Synthetic oligonucleotide
tacaaccacctccca

SEQ ID NO: 1903 - DNA, 15 bp, Artificial Sequence
  Description of Artificial Sequence: Synthetic oligonucleotide
gttttgtcgaaaaga

SEQ ID NO: 1904 - DNA, 15 bp, Artificial Sequence
  Description of Artificial Sequence: Synthetic oligonucleotide
tctgtgtagaaagag

SEQ ID NO: 1905 - DNA, 15 bp, Artificial Sequence
  Description of Artificial Sequence: Synthetic oligonucleotide
atagagaaatcggat

SEQ ID NO: 1906 - DNA, 15 bp, Artificial Sequence
  Description of Artificial Sequence: Synthetic oligonucleotide
tctgtgtagaaagaa

SEQ ID NO: 1907 - DNA, 15 bp, Artificial Sequence
  Description of Artificial Sequence: Synthetic oligonucleotide
gagcgcctctgcccg

SEQ ID NO: 1908 - DNA, 15 bp, Artificial Sequence
  Description of Artificial Sequence: Synthetic oligonucleotide
acctttgttcacttg

SEQ ID NO: 1909 - DNA, 15 bp, Artificial Sequence
  Description of Artificial Sequence: Synthetic oligonucleotide
gagcgcctctgcccc

SEQ ID NO: 1910 - DNA, 15 bp, Artificial Sequence
  Description of Artificial Sequence: Synthetic oligonucleotide
atctcggctcgctac

SEQ ID NO: 1911 - DNA, 15 bp, Artificial Sequence
  Description of Artificial Sequence: Synthetic oligonucleotide
aaaggcgggaagggt

SEQ ID NO: 1912 - DNA, 15 bp, Artificial Sequence
  Description of Artificial Sequence: Synthetic oligonucleotide
gatgtggggagcacc

SEQ ID NO: 1913 - DNA, 15 bp, Artificial Sequence
  Description of Artificial Sequence: Synthetic oligonucleotide
ggggtcagccccccg

SEQ ID NO: 1914 - DNA, 15 bp, Artificial Sequence
  Description of Artificial Sequence: Synthetic oligonucleotide
tatgaccctgccaca

SEQ ID NO: 1915 - DNA, 15 bp, Artificial Sequence
  Description of Artificial Sequence: Synthetic oligonucleotide
gcctcccaaagagcc

SEQ ID NO: 1916 - DNA, 15 bp, Artificial Sequence
  Description of Artificial Sequence: Synthetic oligonucleotide
agcctctgcccggcc

SEQ ID NO: 1917 - DNA, 15 bp, Artificial Sequence
  Description of Artificial Sequence: Synthetic oligonucleotide
ccagggacacaaaca

SEQ ID NO: 1918 - DNA, 15 bp, Artificial Sequence
  Description of Artificial Sequence: Synthetic oligonucleotide
cccggccgccatccc

SEQ ID NO: 1919 - DNA, 15 bp, Artificial Sequence
  Description of Artificial Sequence: Synthetic oligonucleotide
gaggagcgcctctgc

SEQ ID NO: 1920 - DNA, 15 bp, Artificial Sequence
  Description of Artificial Sequence: Synthetic oligonucleotide
tctccctgtcccctc

SEQ ID NO: 1921 - DNA, 15 bp, Artificial Sequence
  Description of Artificial Sequence: Synthetic oligonucleotide
cccgtctgggatgtg

SEQ ID NO: 1922 - DNA, 15 bp, Artificial Sequence
  Description of Artificial Sequence: Synthetic oligonucleotide
tcagccccccgcccg

SEQ ID NO: 1923 - DNA, 15 bp, Artificial Sequence
  Description of Artificial Sequence: Synthetic oligonucleotide
ggggaaatgtgggga

SEQ ID NO: 1924 - DNA, 15 bp, Artificial Sequence
  Description of Artificial Sequence: Synthetic oligonucleotide
cccctctgcccggcc

SEQ ID NO: 1925 - DNA, 15 bp, Artificial Sequence
  Description of Artificial Sequence: Synthetic oligonucleotide
atctgctgaccttcc

SEQ ID NO: 1926 - DNA, 15 bp, Artificial Sequence
  Description of Artificial Sequence: Synthetic oligonucleotide
ggggaaaggtgggga

SEQ ID NO: 1927 - DNA, 15 bp, Artificial Sequence
  Description of Artificial Sequence: Synthetic oligonucleotide
tgctcaatggtgccc

SEQ ID NO: 1928 - DNA, 15 bp, Artificial Sequence
  Description of Artificial Sequence: Synthetic oligonucleotide
tacccccaaccctgt

SEQ ID NO: 1929 - DNA, 15 bp, Artificial Sequence
  Description of Artificial Sequence: Synthetic oligonucleotide
atctgctgaccttct

SEQ ID NO: 1930 - DNA, 15 bp, Artificial Sequence
  Description of Artificial Sequence: Synthetic oligonucleotide
tttgtcgaaaagaaa

SEQ ID NO: 1931 - DNA, 15 bp, Artificial Sequence
  Description of Artificial Sequence: Synthetic oligonucleotide
ttctacggtctccct

SEQ ID NO: 1932 - DNA, 15 bp, Artificial Sequence
  Description of Artificial Sequence: Synthetic oligonucleotide
agatgcttgaaggca

SEQ ID NO: 1933 - DNA, 15 bp, Artificial Sequence
  Description of Artificial Sequence: Synthetic oligonucleotide
ctggctgcccagtct

SEQ ID NO: 1934 - DNA, 15 bp, Artificial Sequence
  Description of Artificial Sequence: Synthetic oligonucleotide
cctcccaaagtgccg

SEQ ID NO: 1935 - DNA, 15 bp, Artificial Sequence
  Description of Artificial Sequence: Synthetic oligonucleotide
ctctgaaacatgtgc

SEQ ID NO: 1936 - DNA, 15 bp, Artificial Sequence
  Description of Artificial Sequence: Synthetic oligonucleotide
ccaaagtgctaagat

SEQ ID NO: 1937 - DNA, 15 bp, Artificial Sequence
  Description of Artificial Sequence: Synthetic oligonucleotide
cgggaggtggggggc

SEQ ID NO: 1938 - DNA, 15 bp, Artificial Sequence
  Description of Artificial Sequence: Synthetic oligonucleotide
acggggtttcgccgt

SEQ ID NO: 1939 - DNA, 15 bp, Artificial Sequence
  Description of Artificial Sequence: Synthetic oligonucleotide
gctcactgcaacctc

SEQ ID NO: 1940 - DNA, 15 bp, Artificial Sequence
  Description of Artificial Sequence: Synthetic oligonucleotide
gatgccgagccaaag

SEQ ID NO: 1941 - DNA, 15 bp, Artificial Sequence
  Description of Artificial Sequence: Synthetic oligonucleotide
gttgccgtgtctgtg

SEQ ID NO: 1942 - DNA, 15 bp, Artificial Sequence
  Description of Artificial Sequence: Synthetic oligonucleotide
cctaggaaaaccaga

SEQ ID NO: 1943 - DNA, 15 bp, Artificial Sequence
  Description of Artificial Sequence: Synthetic oligonucleotide
tggcggttttgtcga

SEQ ID NO: 1944 - DNA, 15 bp, Artificial Sequence
  Description of Artificial Sequence: Synthetic oligonucleotide
tctcccctctctcca

SEQ ID NO: 1945 - DNA, 15 bp, Artificial Sequence
  Description of Artificial Sequence: Synthetic oligonucleotide
cgcgagtgatctgcc

SEQ ID NO: 1946 - DNA, 15 bp, Artificial Sequence
  Description of Artificial Sequence: Synthetic oligonucleotide
tgtgctgtgtcaact

SEQ ID NO: 1947 - DNA, 15 bp, Artificial Sequence
  Description of Artificial Sequence: Synthetic oligonucleotide
tgttcacatgtttat

SEQ ID NO: 1948 - DNA, 15 bp, Artificial Sequence
  Description of Artificial Sequence: Synthetic oligonucleotide
tctccctctcatgcg

SEQ ID NO: 1949 - DNA, 15 bp, Artificial Sequence
  Description of Artificial Sequence: Synthetic oligonucleotide
gaggagcgcctccgc

SEQ ID NO: 1950 - DNA, 15 bp, Artificial Sequence
  Description of Artificial Sequence: Synthetic oligonucleotide
gggaggtgggggggt

SEQ ID NO: 1951 - DNA, 15 bp, Artificial Sequence
  Description of Artificial Sequence: Synthetic oligonucleotide
gtgtggatagaagta

SEQ ID NO: 1952 - DNA, 15 bp, Artificial Sequence
  Description of Artificial Sequence: Synthetic oligonucleotide
aatagaaaaggggga

SEQ ID NO: 1953 - DNA, 15 bp, Artificial Sequence
  Description of Artificial Sequence: Synthetic oligonucleotide
aaggcagcatgctcg

SEQ ID NO: 1954 - DNA, 15 bp, Artificial Sequence
  Description of Artificial Sequence: Synthetic oligonucleotide
accctgccacatccc

SEQ ID NO: 1955 - DNA, 15 bp, Artificial Sequence
  Description of Artificial Sequence: Synthetic oligonucleotide
aagaattatcaataa

SEQ ID NO: 1956 - DNA, 15 bp, Artificial Sequence
  Description of Artificial Sequence: Synthetic oligonucleotide
ccacctcccagccgc

SEQ ID NO: 1957 - DNA, 15 bp, Artificial Sequence
  Description of Artificial Sequence: Synthetic oligonucleotide
ttgttcacatgttta

SEQ ID NO: 1958 - DNA, 15 bp, Artificial Sequence
  Description of Artificial Sequence: Synthetic oligonucleotide
agcccctctgcccgg

SEQ ID NO: 1959 - DNA, 15 bp, Artificial Sequence
  Description of Artificial Sequence: Synthetic oligonucleotide
actccattttgttct

SEQ ID NO: 1960 - DNA, 15 bp, Artificial Sequence
  Description of Artificial Sequence: Synthetic oligonucleotide
gttcactcagtgctc

SEQ ID NO: 1961 - DNA, 15 bp, Artificial Sequence
  Description of Artificial Sequence: Synthetic oligonucleotide
gtcccctctttccac

SEQ ID NO: 1962 - DNA, 15 bp, Artificial Sequence
  Description of Artificial Sequence: Synthetic oligonucleotide
aagggggaaatgtgg

SEQ ID NO: 1963 - DNA, 15 bp, Artificial Sequence
  Description of Artificial Sequence: Synthetic oligonucleotide
ccgggctggtctcca

SEQ ID NO: 1964 - DNA, 15 bp, Artificial Sequence
  Description of Artificial Sequence: Synthetic oligonucleotide
cgccgccacgcctga

SEQ ID NO: 1965 - DNA, 15 bp, Artificial Sequence
  Description of Artificial Sequence: Synthetic oligonucleotide
cgtctgggaggtgag

SEQ ID NO: 1966 - DNA, 15 bp, Artificial Sequence
  Description of Artificial Sequence: Synthetic oligonucleotide
tggtttttgtatttt

SEQ ID NO: 1967 - DNA, 15 bp, Artificial Sequence
  Description of Artificial Sequence: Synthetic oligonucleotide
agtgcagtggcgtga

SEQ ID NO: 1968 - DNA, 15 bp, Artificial Sequence
  Description of Artificial Sequence: Synthetic oligonucleotide
gagaaacacccaaga

SEQ ID NO: 1969 - DNA, 15 bp, Artificial Sequence
  Description of Artificial Sequence: Synthetic oligonucleotide
actggttttcgtatt

SEQ ID NO: 1970 - DNA, 15 bp, Artificial Sequence
  Description of Artificial Sequence: Synthetic oligonucleotide
aagatagagaaatcg

SEQ ID NO: 1971 - DNA, 15 bp, Artificial Sequence
  Description of Artificial Sequence: Synthetic oligonucleotide
cctgcgattgcaggc

SEQ ID NO: 1972 - DNA, 15 bp, Artificial Sequence
  Description of Artificial Sequence: Synthetic oligonucleotide
aagtgccgagattgc

SEQ ID NO: 1973 - DNA, 15 bp, Artificial Sequence
  Description of Artificial Sequence: Synthetic oligonucleotide
tgctgaccttccctc

SEQ ID NO: 1974 - DNA, 15 bp, Artificial Sequence
  Description of Artificial Sequence: Synthetic oligonucleotide
attttgttctgtact

SEQ ID NO: 1975 - DNA, 15 bp, Artificial Sequence
  Description of Artificial Sequence: Synthetic oligonucleotide
atgatcaataaatac

SEQ ID NO: 1976 - DNA, 15 bp, Artificial Sequence
  Description of Artificial Sequence: Synthetic oligonucleotide
ctgccgccatctcgg

SEQ ID NO: 1977 - DNA, 15 bp, Artificial Sequence
  Description of Artificial Sequence: Synthetic oligonucleotide
gtctgggaggtgtac

SEQ ID NO: 1978 - DNA, 15 bp, Artificial Sequence
  Description of Artificial Sequence: Synthetic oligonucleotide
aggtgtacccagcga

SEQ ID NO: 1979 - DNA, 15 bp, Artificial Sequence
  Description of Artificial Sequence: Synthetic oligonucleotide
ttttggtggagacgg

SEQ ID NO: 1980 - DNA, 15 bp, Artificial Sequence
  Description of Artificial Sequence: Synthetic oligonucleotide
tttttgtatttttgg

SEQ ID NO: 1981 - DNA, 15 bp, Artificial Sequence
  Description of Artificial Sequence: Synthetic oligonucleotide
aatcggattgttgct

SEQ ID NO: 1982 - DNA, 15 bp, Artificial Sequence
  Description of Artificial Sequence: Synthetic oligonucleotide
ttgccgtgtctgtgt

SEQ ID NO: 1983 - DNA, 15 bp, Artificial Sequence
  Description of Artificial Sequence: Synthetic oligonucleotide
tctgccccgccgccc

SEQ ID NO: 1984 - DNA, 15 bp, Artificial Sequence
  Description of Artificial Sequence: Synthetic oligonucleotide
tcccaaagagccgga

SEQ ID NO: 1985 - DNA, 15 bp, Artificial Sequence
  Description of Artificial Sequence: Synthetic oligonucleotide
cctacacctcccagc

SEQ ID NO: 1986 - DNA, 15 bp, Artificial Sequence
  Description of Artificial Sequence: Synthetic oligonucleotide
acgatggcggttttg

SEQ ID NO: 1987 - DNA, 15 bp, Artificial Sequence
  Description of Artificial Sequence: Synthetic oligonucleotide
cccgcctcggcctcc

SEQ ID NO: 1988 - DNA, 15 bp, Artificial Sequence
  Description of Artificial Sequence: Synthetic oligonucleotide
ggatgtgaggagcgc

SEQ ID NO: 1989 - DNA, 15 bp, Artificial Sequence
  Description of Artificial Sequence: Synthetic oligonucleotide
ccgggccggtctcca

SEQ ID NO: 1990 - DNA, 15 bp, Artificial Sequence
  Description of Artificial Sequence: Synthetic oligonucleotide
ggctgcccagtctgg

SEQ ID NO: 1991 - DNA, 15 bp, Artificial Sequence
  Description of Artificial Sequence: Synthetic oligonucleotide
ctgtgtccactcagg

SEQ ID NO: 1992 - DNA, 15 bp, Artificial Sequence
  Description of Artificial Sequence: Synthetic oligonucleotide
agtcatcaccactcc

SEQ ID NO: 1993 - DNA, 15 bp, Artificial Sequence
  Description of Artificial Sequence: Synthetic oligonucleotide
ctggttttggtggag

SEQ ID NO: 1994 - DNA, 15 bp, Artificial Sequence
  Description of Artificial Sequence: Synthetic oligonucleotide
ggtgtgcccagcggc

SEQ ID NO: 1995 - DNA, 15 bp, Artificial Sequence
  Description of Artificial Sequence: Synthetic oligonucleotide
cgagccgaagctgga

SEQ ID NO: 1996 - DNA, 15 bp, Artificial Sequence
  Description of Artificial Sequence: Synthetic oligonucleotide
gggctccagtgattc

SEQ ID NO: 1997 - DNA, 15 bp, Artificial Sequence
  Description of Artificial Sequence: Synthetic oligonucleotide
tccactattatccta

SEQ ID NO: 1998 - DNA, 15 bp, Artificial Sequence
  Description of Artificial Sequence: Synthetic oligonucleotide
gaagctggactgtac

SEQ ID NO: 1999 - DNA, 15 bp, Artificial Sequence
  Description of Artificial Sequence: Synthetic oligonucleotide
ggccgcccagtctgg

SEQ ID NO: 2000 - DNA, 15 bp, Artificial Sequence
  Description of Artificial Sequence: Synthetic oligonucleotide
tggagacggggtttc

SEQ ID NO: 2001 - DNA, 15 bp, Artificial Sequence
  Description of Artificial Sequence: Synthetic oligonucleotide
tcacttgtttatctg

SEQ ID NO: 2002 - DNA, 15 bp, Artificial Sequence
  Description of Artificial Sequence: Synthetic oligonucleotide
ccctgccacatcccc

SEQ ID NO: 2003 - DNA, 15 bp, Artificial Sequence
  Description of Artificial Sequence: Synthetic oligonucleotide
tctcctgcctcggcc

SEQ ID NO: 2004 - DNA, 15 bp, Artificial Sequence
  Description of Artificial Sequence: Synthetic oligonucleotide
taggagactccattt

SEQ ID NO: 2005 - DNA, 15 bp, Artificial Sequence
  Description of Artificial Sequence: Synthetic oligonucleotide
gacggagtctggttc

SEQ ID NO: 2006 - DNA, 15 bp, Artificial Sequence
  Description of Artificial Sequence: Synthetic oligonucleotide
ttggccgggctggtc

SEQ ID NO: 2007 - DNA, 15 bp, Artificial Sequence
  Description of Artificial Sequence: Synthetic oligonucleotide
gaaaaccagagacct

SEQ ID NO: 2008 - DNA, 15 bp, Artificial Sequence
  Description of Artificial Sequence: Synthetic oligonucleotide
gatgtgaggagcccc

SEQ ID NO: 2009 - DNA, 15 bp, Artificial Sequence
  Description of Artificial Sequence: Synthetic oligonucleotide
tagaagtagacatgg

SEQ ID NO: 2010 - DNA, 15 bp, Artificial Sequence
  Description of Artificial Sequence: Synthetic oligonucleotide
ccctctccctgtccc

SEQ ID NO: 2011 - DNA, 15 bp, Artificial Sequence
  Description of Artificial Sequence: Synthetic oligonucleotide
tgggatgctgttaat

SEQ ID NO: 2012 - DNA, 15 bp, Artificial Sequence
  Description of Artificial Sequence: Synthetic oligonucleotide
cccgaggtgccggga

SEQ ID NO: 2013 - DNA, 15 bp, Artificial Sequence
  Description of Artificial Sequence: Synthetic oligonucleotide
catcccgtctgggaa

SEQ ID NO: 2014 - DNA, 15 bp, Artificial Sequence
  Description of Artificial Sequence: Synthetic oligonucleotide
tcaatggtgcccagg

SEQ ID NO: 2015 - DNA, 15 bp, Artificial Sequence
  Description of Artificial Sequence: Synthetic oligonucleotide
ccggccgccccttct

SEQ ID NO: 2016 - DNA, 15 bp, Artificial Sequence
  Description of Artificial Sequence: Synthetic oligonucleotide
gacaatggcggtttt

SEQ ID NO: 2017 - DNA, 15 bp, Artificial Sequence
  Description of Artificial Sequence: Synthetic oligonucleotide
accattgagaacggg

SEQ ID NO: 2018 - DNA, 15 bp, Artificial Sequence
  Description of Artificial Sequence: Synthetic oligonucleotide
aaaagaaaaggggga

SEQ ID NO: 2019 - DNA, 15 bp, Artificial Sequence
  Description of Artificial Sequence: Synthetic oligonucleotide
caacagctcattgag

SEQ ID NO: 2020 - DNA, 15 bp, Artificial Sequence
  Description of Artificial Sequence: Synthetic oligonucleotide
gagaacgggccagga

SEQ ID NO: 2021 - DNA, 15 bp, Artificial Sequence
  Description of Artificial Sequence: Synthetic oligonucleotide
ctgaccgcgagtgat

SEQ ID NO: 2022 - DNA, 15 bp, Artificial Sequence
  Description of Artificial Sequence: Synthetic oligonucleotide
atcagggacacaaac

SEQ ID NO: 2023 - DNA, 15 bp, Artificial Sequence
  Description of Artificial Sequence: Synthetic oligonucleotide
cgcccctactgggaa

SEQ ID NO: 2024 - DNA, 15 bp, Artificial Sequence
  Description of Artificial Sequence: Synthetic oligonucleotide
tgcagacggagtctc

SEQ ID NO: 2025 - DNA, 15 bp, Artificial Sequence
  Description of Artificial Sequence: Synthetic oligonucleotide
agggcggtgcaagat

SEQ ID NO: 2026 - DNA, 15 bp, Artificial Sequence
  Description of Artificial Sequence: Synthetic oligonucleotide
tgttcacgtgtttat

SEQ ID NO: 2027 - DNA, 15 bp, Artificial Sequence
  Description of Artificial Sequence: Synthetic oligonucleotide
tgcagacggagtctg

SEQ ID NO: 2028 - DNA, 15 bp, Artificial Sequence
  Description of Artificial Sequence: Synthetic oligonucleotide
gaaaagggggaaatg

SEQ ID NO: 2029 - DNA, 15 bp, Artificial Sequence
  Description of Artificial Sequence: Synthetic oligonucleotide
gccgcccatcgtctg

SEQ ID NO: 2030 - DNA, 15 bp, Artificial Sequence
  Description of Artificial Sequence: Synthetic oligonucleotide
atgtgctttgttaaa

SEQ ID NO: 2031 - DNA, 15 bp, Artificial Sequence
  Description of Artificial Sequence: Synthetic oligonucleotide
ctgtgtagaaagaag

SEQ ID NO: 2032 - DNA, 15 bp, Artificial Sequence
  Description of Artificial Sequence: Synthetic oligonucleotide
cgtgttggccgggct

SEQ ID NO: 2033 - DNA, 15 bp, Artificial Sequence
  Description of Artificial Sequence: Synthetic oligonucleotide
gtgtgcccaacagct

SEQ ID NO: 2034 - DNA, 15 bp, Artificial Sequence
  Description of Artificial Sequence: Synthetic oligonucleotide
cagccgccccgtccg

SEQ ID NO: 2035 - DNA, 15 bp, Artificial Sequence
  Description of Artificial Sequence: Synthetic oligonucleotide
tgccgaggctggact

SEQ ID NO: 2036 - DNA, 15 bp, Artificial Sequence
  Description of Artificial Sequence: Synthetic oligonucleotide
ctaggaagtgaggag

SEQ ID NO: 2037 - DNA, 15 bp, Artificial Sequence
  Description of Artificial Sequence: Synthetic oligonucleotide
aaacagatgcttgaa

SEQ ID NO: 2038 - DNA, 15 bp, Artificial Sequence
  Description of Artificial Sequence: Synthetic oligonucleotide
agtacccagggacac

SEQ ID NO: 2039 - DNA, 15 bp, Artificial Sequence
  Description of Artificial Sequence: Synthetic oligonucleotide
tctccctctccctgt

SEQ ID NO: 2040 - DNA, 15 bp, Artificial Sequence
  Description of Artificial Sequence: Synthetic oligonucleotide
tgttggccgggccgg

SEQ ID NO: 2041 - DNA, 15 bp, Artificial Sequence
  Description of Artificial Sequence: Synthetic oligonucleotide
gcagtggcgtgatct

SEQ ID NO: 2042 - DNA, 15 bp, Artificial Sequence
  Description of Artificial Sequence: Synthetic oligonucleotide
agccggattgcagcc

SEQ ID NO: 2043 - DNA, 15 bp, Artificial Sequence
  Description of Artificial Sequence: Synthetic oligonucleotide
ggccgcagggacctc

SEQ ID NO: 2044 - DNA, 15 bp, Artificial Sequence
  Description of Artificial Sequence: Synthetic oligonucleotide
aaagaaaagggggaa

SEQ ID NO: 2045 - DNA, 15 bp, Artificial Sequence
  Description of Artificial Sequence: Synthetic oligonucleotide
acgggccaggatgac

SEQ ID NO: 2046 - DNA, 15 bp, Artificial Sequence
  Description of Artificial Sequence: Synthetic oligonucleotide
agcctgccgagtgcc

SEQ ID NO: 2047 - DNA, 15 bp, Artificial Sequence
  Description of Artificial Sequence: Synthetic oligonucleotide
aacactgcggaaggc

SEQ ID NO: 2048 - DNA, 15 bp, Artificial Sequence
  Description of Artificial Sequence: Synthetic oligonucleotide
tgtttatctgctgac

SEQ ID NO: 2049 - DNA, 15 bp, Artificial Sequence
  Description of Artificial Sequence: Synthetic oligonucleotide
tgtgtagaaagaggt

SEQ ID NO: 2050 - DNA, 15 bp, Artificial Sequence
  Description of Artificial Sequence: Synthetic oligonucleotide
tgcagtggcgtgatc

SEQ ID NO: 2051 - DNA, 15 bp, Artificial Sequence
  Description of Artificial Sequence: Synthetic oligonucleotide
cgcagggtcctctgc

SEQ ID NO: 2052 - DNA, 15 bp, Artificial Sequence
  Description of Artificial Sequence: Synthetic oligonucleotide
cactgcaacctccct

SEQ ID NO: 2053 - DNA, 15 bp, Artificial Sequence
  Description of Artificial Sequence: Synthetic oligonucleotide
tgtgctttgttaaac

SEQ ID NO: 2054 - DNA, 15 bp, Artificial Sequence
  Description of Artificial Sequence: Synthetic oligonucleotide
tatgaccctgccaaa

SEQ ID NO: 2055 - DNA, 15 bp, Artificial Sequence
  Description of Artificial Sequence: Synthetic oligonucleotide
ctctgcccggccagc

SEQ ID NO: 2056 - DNA, 15 bp, Artificial Sequence
  Description of Artificial Sequence: Synthetic oligonucleotide
ccactattgtcccat

SEQ ID NO: 2057 - DNA, 15 bp, Artificial Sequence
  Description of Artificial Sequence: Synthetic oligonucleotide
ccactattatcctat

SEQ ID NO: 2058 - DNA, 15 bp, Artificial Sequence
  Description of Artificial Sequence: Synthetic oligonucleotide
atgacaatggcggct

SEQ ID NO: 2059 - DNA, 15 bp, Artificial Sequence
  Description of Artificial Sequence: Synthetic oligonucleotide
ctgtactaagaaaaa

SEQ ID NO: 2060 - DNA, 15 bp, Artificial Sequence
  Description of Artificial Sequence: Synthetic oligonucleotide
tgtgaggagcccctc

SEQ ID NO: 2061 - DNA, 15 bp, Artificial Sequence
  Description of Artificial Sequence: Synthetic oligonucleotide
ttcgccgtgttggcc

SEQ ID NO: 2062 - DNA, 15 bp, Artificial Sequence
  Description of Artificial Sequence: Synthetic oligonucleotide
atagaagtagacatg

SEQ ID NO: 2063 - DNA, 15 bp, Artificial Sequence
  Description of Artificial Sequence: Synthetic oligonucleotide
taatctcaagtaatc

SEQ ID NO: 2064 - DNA, 15 bp, Artificial Sequence
  Description of Artificial Sequence: Synthetic oligonucleotide
aaagagagatcagat

SEQ ID NO: 2065 - DNA, 15 bp, Artificial Sequence
  Description of Artificial Sequence: Synthetic oligonucleotide
tcatcaccactccct

SEQ ID NO: 2066 - DNA, 15 bp, Artificial Sequence
  Description of Artificial Sequence: Synthetic oligonucleotide
tgctgttgatctgtg

SEQ ID NO: 2067 - DNA, 15 bp, Artificial Sequence
  Description of Artificial Sequence: Synthetic oligonucleotide
catccccctctccga

SEQ ID NO: 2068 - DNA, 15 bp, Artificial Sequence
  Description of Artificial Sequence: Synthetic oligonucleotide
gaggagcccctctgc

SEQ ID NO: 2069 - DNA, 15 bp, Artificial Sequence
  Description of Artificial Sequence: Synthetic oligonucleotide
ctgtactgccgccat

SEQ ID NO: 2070 - DNA, 15 bp, Artificial Sequence
  Description of Artificial Sequence: Synthetic oligonucleotide
ggtggagacggggtt

SEQ ID NO: 2071 - DNA, 15 bp, Artificial Sequence
  Description of Artificial Sequence: Synthetic oligonucleotide
gttttcgtatttttt

SEQ ID NO: 2072 - DNA, 15 bp, Artificial Sequence
  Description of Artificial Sequence: Synthetic oligonucleotide
acctctgccccgccg

SEQ ID NO: 2073 - DNA, 15 bp, Artificial Sequence
  Description of Artificial Sequence: Synthetic oligonucleotide
actgtactgctgcca

SEQ ID NO: 2074 - DNA, 15 bp, Artificial Sequence
  Description of Artificial Sequence: Synthetic oligonucleotide
tgtacccaacagctc

SEQ ID NO: 2075 - DNA, 15 bp, Artificial Sequence
  Description of Artificial Sequence: Synthetic oligonucleotide
gatggttgccgtgtc

SEQ ID NO: 2076 - DNA, 15 bp, Artificial Sequence
  Description of Artificial Sequence: Synthetic oligonucleotide
cagtggcgtgatctc

SEQ ID NO: 2077 - DNA, 15 bp, Artificial Sequence
  Description of Artificial Sequence: Synthetic oligonucleotide
gtgtccactcagggt

SEQ ID NO: 2078 - DNA, 15 bp, Artificial Sequence
  Description of Artificial Sequence: Synthetic oligonucleotide
tagaaagaggtagac

SEQ ID NO: 2079 - DNA, 15 bp, Artificial Sequence
  Description of Artificial Sequence: Synthetic oligonucleotide
ctcgggctccagtga

SEQ ID NO: 2080 - DNA, 15 bp, Artificial Sequence
  Description of Artificial Sequence: Synthetic oligonucleotide
gcccagcggctcatt

SEQ ID NO: 2081 - DNA, 15 bp, Artificial Sequence
  Description of Artificial Sequence: Synthetic oligonucleotide
cagtgattctcctgc

SEQ ID NO: 2082 - DNA, 15 bp, Artificial Sequence
  Description of Artificial Sequence: Synthetic oligonucleotide
gcctctgcccggcca

SEQ ID NO: 2083 - DNA, 15 bp, Artificial Sequence
  Description of Artificial Sequence: Synthetic oligonucleotide
tgtgtcaactcaggg

SEQ ID NO: 2084 - DNA, 15 bp, Artificial Sequence
  Description of Artificial Sequence: Synthetic oligonucleotide
tgtgtctgtgtagaa

SEQ ID NO: 2085 - DNA, 15 bp, Artificial Sequence
  Description of Artificial Sequence: Synthetic oligonucleotide
ttgtcccatgaccct

SEQ ID NO: 2086 - DNA, 15 bp, Artificial Sequence
  Description of Artificial Sequence: Synthetic oligonucleotide
aaacacccaagaatt

SEQ ID NO: 2087 - DNA, 15 bp, Artificial Sequence
  Description of Artificial Sequence: Synthetic oligonucleotide
aaggggggaaaggtg

SEQ ID NO: 2088 - DNA, 15 bp, Artificial Sequence
  Description of Artificial Sequence: Synthetic oligonucleotide
ttttgtatttttggt

SEQ ID NO: 2089 - DNA, 15 bp, Artificial Sequence
  Description of Artificial Sequence: Synthetic oligonucleotide
ttatctgctgacctt

SEQ ID NO: 2090 - DNA, 15 bp, Artificial Sequence
  Description of Artificial Sequence: Synthetic oligonucleotide
aagagccggattgca

SEQ ID NO: 2091 - DNA, 15 bp, Artificial Sequence
  Description of Artificial Sequence: Synthetic oligonucleotide
aagtgaggagcccct

SEQ ID NO: 2092 - DNA, 15 bp, Artificial Sequence
  Description of Artificial Sequence: Synthetic oligonucleotide
cctggcctcgagtga

SEQ ID NO: 2093 - DNA, 15 bp, Artificial Sequence
  Description of Artificial Sequence: Synthetic oligonucleotide
actgcaacctccctg

SEQ ID NO: 2094 - DNA, 15 bp, Artificial Sequence
  Description of Artificial Sequence: Synthetic oligonucleotide
gcccggccaccgccc

SEQ ID NO: 2095 - DNA, 15 bp, Artificial Sequence
  Description of Artificial Sequence: Synthetic oligonucleotide
aactcagggttaaat

SEQ ID NO: 2096 - DNA, 15 bp, Artificial Sequence
  Description of Artificial Sequence: Synthetic oligonucleotide
ctggccgcccatcgt

SEQ ID NO: 2097 - DNA, 15 bp, Artificial Sequence
  Description of Artificial Sequence: Synthetic oligonucleotide
caggctggagtgcag

SEQ ID NO: 2098 - DNA, 15 bp, Artificial Sequence
  Description of Artificial Sequence: Synthetic oligonucleotide
tgccacatccccctc

SEQ ID NO: 2099 - DNA, 15 bp, Artificial Sequence
  Description of Artificial Sequence: Synthetic oligonucleotide
ggccgggccggtctc

SEQ ID NO: 2100 - DNA, 15 bp, Artificial Sequence
  Description of Artificial Sequence: Synthetic oligonucleotide
ctgactggtttttgt

SEQ ID NO: 2101 - DNA, 15 bp, Artificial Sequence
  Description of Artificial Sequence: Synthetic oligonucleotide
agggttaaatggatt

SEQ ID NO: 2102 - DNA, 15 bp, Artificial Sequence
  Description of Artificial Sequence: Synthetic oligonucleotide
tgccgagtgcctgcg

SEQ ID NO: 2103 - DNA, 15 bp, Artificial Sequence
  Description of Artificial Sequence: Synthetic oligonucleotide
agtctgggaagtgag

SEQ ID NO: 2104 - DNA, 15 bp, Artificial Sequence
  Description of Artificial Sequence: Synthetic oligonucleotide
ttgttactgtgtctg

SEQ ID NO: 2105 - DNA, 15 bp, Artificial Sequence
  Description of Artificial Sequence: Synthetic oligonucleotide
cgctgtgttgaccgg

SEQ ID NO: 2106 - DNA, 15 bp, Artificial Sequence
  Description of Artificial Sequence: Synthetic oligonucleotide
acgtgtttatctgct

SEQ ID NO: 2107 - DNA, 15 bp, Artificial Sequence
  Description of Artificial Sequence: Synthetic oligonucleotide
aacatgtgctgtgtc

SEQ ID NO: 2108 - DNA, 15 bp, Artificial Sequence
  Description of Artificial Sequence: Synthetic oligonucleotide
gccatgatgacgatg

SEQ ID NO: 2109 - DNA, 15 bp, Artificial Sequence
  Description of Artificial Sequence: Synthetic oligonucleotide
aacgggccatgatga

SEQ ID NO: 2110 - DNA, 15 bp, Artificial Sequence
  Description of Artificial Sequence: Synthetic oligonucleotide
tgtgctctctgaaac

SEQ ID NO: 2111 - DNA, 15 bp, Artificial Sequence
  Description of Artificial Sequence: Synthetic oligonucleotide
aggagcgcctcttcc

SEQ ID NO: 2112 - DNA, 15 bp, Artificial Sequence
  Description of Artificial Sequence: Synthetic oligonucleotide
ctctgcctggccgcc

SEQ ID NO: 2113 - DNA, 15 bp, Artificial Sequence
  Description of Artificial Sequence: Synthetic oligonucleotide
tcggatggttgccgg

SEQ ID NO: 2114 - DNA, 15 bp, Artificial Sequence
  Description of Artificial Sequence: Synthetic oligonucleotide
ggccgccaccccgtc

SEQ ID NO: 2115 - DNA, 15 bp, Artificial Sequence
  Description of Artificial Sequence: Synthetic oligonucleotide
ctcctgcctcagcct

SEQ ID NO: 2116 - DNA, 15 bp, Artificial Sequence
  Description of Artificial Sequence: Synthetic oligonucleotide
gctcaatggtgccca

SEQ ID NO: 2117 - DNA, 15 bp, Artificial Sequence
  Description of Artificial Sequence: Synthetic oligonucleotide
aatgtggggaaaaga

SEQ ID NO: 2118 - DNA, 15 bp, Artificial Sequence
  Description of Artificial Sequence: Synthetic oligonucleotide
cggatggttgccggg

SEQ ID NO: 2119 - DNA, 15 bp, Artificial Sequence
  Description of Artificial Sequence: Synthetic oligonucleotide
ttctgtactaagaaa

SEQ ID NO: 2120 - DNA, 15 bp, Artificial Sequence
  Description of Artificial Sequence: Synthetic oligonucleotide
aaaggggggaaaggt

SEQ ID NO: 2121 - DNA, 15 bp, Artificial Sequence
  Description of Artificial Sequence: Synthetic oligonucleotide
tctgtactaagaaaa

SEQ ID NO: 2122 - DNA, 15 bp, Artificial Sequence
  Description of Artificial Sequence: Synthetic oligonucleotide
cgcctcttcccggcc

SEQ ID NO: 2123 - DNA, 15 bp, Artificial Sequence
  Description of Artificial Sequence: Synthetic oligonucleotide
ccaccgccccgtctg

SEQ ID NO: 2124 - DNA, 15 bp, Artificial Sequence
  Description of Artificial Sequence: Synthetic oligonucleotide
tgatctgcccgcctc

SEQ ID NO: 2125 - DNA, 15 bp, Artificial Sequence
  Description of Artificial Sequence: Synthetic oligonucleotide
agtagacatgggaga

SEQ ID NO: 2126 - DNA, 15 bp, Artificial Sequence
  Description of Artificial Sequence: Synthetic oligonucleotide
catgtgctgtgtcca

SEQ ID NO: 2127 - DNA, 15 bp, Artificial Sequence
  Description of Artificial Sequence: Synthetic oligonucleotide
caaccacctcccagc

SEQ ID NO: 2128 - DNA, 15 bp, Artificial Sequence
  Description of Artificial Sequence: Synthetic oligonucleotide
ctctccctctccctg

SEQ ID NO: 2129 - DNA, 15 bp, Artificial Sequence
  Description of Artificial Sequence: Synthetic oligonucleotide
ccgagccgaggctgg

SEQ ID NO: 2130 - DNA, 15 bp, Artificial Sequence
  Description of Artificial Sequence: Synthetic oligonucleotide
acaacctccacctcc

SEQ ID NO: 2131 - DNA, 15 bp, Artificial Sequence
  Description of Artificial Sequence: Synthetic oligonucleotide
cagggacacaaacac

SEQ ID NO: 2132 - DNA, 15 bp, Artificial Sequence
  Description of Artificial Sequence: Synthetic oligonucleotide
tcctgttgatctgtg

SEQ ID NO: 2133 - DNA, 15 bp, Artificial Sequence
  Description of Artificial Sequence: Synthetic oligonucleotide
cccctctgcctggcc

SEQ ID NO: 2134 - DNA, 15 bp, Artificial Sequence
  Description of Artificial Sequence: Synthetic oligonucleotide
gggaaaagatagaga

SEQ ID NO: 2135 - DNA, 15 bp, Artificial Sequence
  Description of Artificial Sequence: Synthetic oligonucleotide
tcaccactccctaat

SEQ ID NO: 2136 - DNA, 15 bp, Artificial Sequence
  Description of Artificial Sequence: Synthetic oligonucleotide
ctgactggttttcgt

SEQ ID NO: 2137 - DNA, 15 bp, Artificial Sequence
  Description of Artificial Sequence: Synthetic oligonucleotide
ccgcccctactggga

SEQ ID NO: 2138 - DNA, 15 bp, Artificial Sequence
  Description of Artificial Sequence: Synthetic oligonucleotide
cctatgaccctgcca

SEQ ID NO: 2139 - DNA, 15 bp, Artificial Sequence
  Description of Artificial Sequence: Synthetic oligonucleotide
agccgaggctggact

SEQ ID NO: 2140 - DNA, 15 bp, Artificial Sequence
  Description of Artificial Sequence: Synthetic oligonucleotide
cccccaaccccgtgc

SEQ ID NO: 2141 - DNA, 15 bp, Artificial Sequence
  Description of Artificial Sequence: Synthetic oligonucleotide
cgtctgggatgtgag

SEQ ID NO: 2142 - DNA, 15 bp, Artificial Sequence
  Description of Artificial Sequence: Synthetic oligonucleotide
cctgccgagtgcctg

SEQ ID NO: 2143 - DNA, 15 bp, Artificial Sequence
  Description of Artificial Sequence: Synthetic oligonucleotide
atcaccactccctaa

SEQ ID NO: 2144 - DNA, 15 bp, Artificial Sequence
  Description of Artificial Sequence: Synthetic oligonucleotide
aggcgcgcgccgcca

SEQ ID NO: 2145 - DNA, 15 bp, Artificial Sequence
  Description of Artificial Sequence: Synthetic oligonucleotide
agcgcctctgccccg

SEQ ID NO: 2146 - DNA, 15 bp, Artificial Sequence
  Description of Artificial Sequence: Synthetic oligonucleotide
tttgtcgaatagaaa

SEQ ID NO: 2147 - DNA, 15 bp, Artificial Sequence
  Description of Artificial Sequence: Synthetic oligonucleotide
ggtgtacccaacagc

SEQ ID NO: 2148 - DNA, 15 bp, Artificial Sequence
  Description of Artificial Sequence: Synthetic oligonucleotide
ttcactcagtgctca

SEQ ID NO: 2149 - DNA, 15 bp, Artificial Sequence
  Description of Artificial Sequence: Synthetic oligonucleotide
gactggttttggtgg

SEQ ID NO: 2150 - DNA, 15 bp, Artificial Sequence
  Description of Artificial Sequence: Synthetic oligonucleotide
gggacacaaacactg

SEQ ID NO: 2151 - DNA, 15 bp, Artificial Sequence
  Description of Artificial Sequence: Synthetic oligonucleotide
tcgaatagaaaaggg

SEQ ID NO: 2152 - DNA, 15 bp, Artificial Sequence
  Description of Artificial Sequence: Synthetic oligonucleotide
gaaatcggatggttg

SEQ ID NO: 2153 - DNA, 15 bp, Artificial Sequence
  Description of Artificial Sequence: Synthetic oligonucleotide
ggccagccgccccgt

SEQ ID NO: 2154 - DNA, 15 bp, Artificial Sequence
  Description of Artificial Sequence: Synthetic oligonucleotide
ctggagtgcagtggc

SEQ ID NO: 2155 - DNA, 15 bp, Artificial Sequence
  Description of Artificial Sequence: Synthetic oligonucleotide
agaaaaattcttctg

SEQ ID NO: 2156 - DNA, 15 bp, Artificial Sequence
  Description of Artificial Sequence: Synthetic oligonucleotide
cactattgtcccatg

SEQ ID NO: 2157 - DNA, 15 bp, Artificial Sequence
  Description of Artificial Sequence: Synthetic oligonucleotide
ccggccaccaccccg

SEQ ID NO: 2158 - DNA, 15 bp, Artificial Sequence
  Description of Artificial Sequence: Synthetic oligonucleotide
ccgccatcccatcta

SEQ ID NO: 2159 - DNA, 15 bp, Artificial Sequence
  Description of Artificial Sequence: Synthetic oligonucleotide
tctgtgagaaacacc

SEQ ID NO: 2160 - DNA, 15 bp, Artificial Sequence
  Description of Artificial Sequence: Synthetic oligonucleotide
caatgttgcccaggc

SEQ ID NO: 2161 - DNA, 15 bp, Artificial Sequence
  Description of Artificial Sequence: Synthetic oligonucleotide
gtctgtgtagaaaga

SEQ ID NO: 2162 - DNA, 15 bp, Artificial Sequence
  Description of Artificial Sequence: Synthetic oligonucleotide
tgacaatggcggctt

SEQ ID NO: 2163 - DNA, 15 bp, Artificial Sequence
  Description of Artificial Sequence: Synthetic oligonucleotide
ccctctgcctggccg

SEQ ID NO: 2164 - DNA, 15 bp, Artificial Sequence
  Description of Artificial Sequence: Synthetic oligonucleotide
tccctgtcccctctt

SEQ ID NO: 2165 - DNA, 15 bp, Artificial Sequence
  Description of Artificial Sequence: Synthetic oligonucleotide
cgaggctggactgta

SEQ ID NO: 2166 - DNA, 15 bp, Artificial Sequence
  Description of Artificial Sequence: Synthetic oligonucleotide
tgacaatggcggttt

SEQ ID NO: 2167 - DNA, 15 bp, Artificial Sequence
  Description of Artificial Sequence: Synthetic oligonucleotide
aaaaaaattaaaaaa

SEQ ID NO: 2168 - DNA, 15 bp, Artificial Sequence
  Description of Artificial Sequence: Synthetic oligonucleotide
tctgggatgtgagga

SEQ ID NO: 2169 - DNA, 15 bp, Artificial Sequence
  Description of Artificial Sequence: Synthetic oligonucleotide
gggaagggtggggaa

SEQ ID NO: 2170 - DNA, 15 bp, Artificial Sequence
  Description of Artificial Sequence: Synthetic oligonucleotide
aaaagatagagaaat

SEQ ID NO: 2171 - DNA, 15 bp, Artificial Sequence
  Description of Artificial Sequence: Synthetic oligonucleotide
tgtactaagaaaaat

SEQ ID NO: 2172 - DNA, 15 bp, Artificial Sequence
  Description of Artificial Sequence: Synthetic oligonucleotide
tgctgtgtccactca

SEQ ID NO: 2173 - DNA, 15 bp, Artificial Sequence
  Description of Artificial Sequence: Synthetic oligonucleotide
aagagtcatcaccac

SEQ ID NO: 2174 - DNA, 15 bp, Artificial Sequence
  Description of Artificial Sequence: Synthetic oligonucleotide
ctctcccctctctcc

SEQ ID NO: 2175 - DNA, 15 bp, Artificial Sequence
  Description of Artificial Sequence: Synthetic oligonucleotide
atgtttatctgctga

SEQ ID NO: 2176 - DNA, 15 bp, Artificial Sequence
  Description of Artificial Sequence: Synthetic oligonucleotide
caaacactgcggaag

SEQ ID NO: 2177 - DNA, 15 bp, Artificial Sequence
  Description of Artificial Sequence: Synthetic oligonucleotide
catgtttatctgctg

SEQ ID NO: 2178 - DNA, 15 bp, Artificial Sequence
  Description of Artificial Sequence: Synthetic oligonucleotide
tgcaggcacgcgccg

SEQ ID NO: 2179 - DNA, 15 bp, Artificial Sequence
  Description of Artificial Sequence: Synthetic oligonucleotide
ccgagaaacacccaa

SEQ ID NO: 2180 - DNA, 15 bp, Artificial Sequence
  Description of Artificial Sequence: Synthetic oligonucleotide
aggtgtgcccagcgg

SEQ ID NO: 2181 - DNA, 15 bp, Artificial Sequence
  Description of Artificial Sequence: Synthetic oligonucleotide
ccgtgtctgtgtaga

SEQ ID NO: 2182 - DNA, 15 bp, Artificial Sequence
  Description of Artificial Sequence: Synthetic oligonucleotide
tgtcgaatagaaaag

SEQ ID NO: 2183 - DNA, 15 bp, Artificial Sequence
  Description of Artificial Sequence: Synthetic oligonucleotide
cggggtttcgctgtg

SEQ ID NO: 2184 - DNA, 15 bp, Artificial Sequence
  Description of Artificial Sequence: Synthetic oligonucleotide
gagtgcctgcgattg

SEQ ID NO: 2185 - DNA, 15 bp, Artificial Sequence
  Description of Artificial Sequence: Synthetic oligonucleotide
tacaacctccacctc

SEQ ID NO: 2186 - DNA, 15 bp, Artificial Sequence
  Description of Artificial Sequence: Synthetic oligonucleotide
ccttccctccactat

SEQ ID NO: 2187 - DNA, 15 bp, Artificial Sequence
  Description of Artificial Sequence: Synthetic oligonucleotide
tggggaaaagattga

SEQ ID NO: 2188 - DNA, 15 bp, Artificial Sequence
  Description of Artificial Sequence: Synthetic oligonucleotide
tccctctgttgccga

SEQ ID NO: 2189 - DNA, 15 bp, Artificial Sequence
  Description of Artificial Sequence: Synthetic oligonucleotide
gcaggcacgcgccgc

SEQ ID NO: 2190 - DNA, 15 bp, Artificial Sequence
  Description of Artificial Sequence: Synthetic oligonucleotide
taaccttacccccaa

SEQ ID NO: 2191 - DNA, 15 bp, Artificial Sequence
  Description of Artificial Sequence: Synthetic oligonucleotide
ccgcccggccagccg

SEQ ID NO: 2192 - DNA, 15 bp, Artificial Sequence
  Description of Artificial Sequence: Synthetic oligonucleotide
ctcccaaagtgccga

SEQ ID NO: 2193 - DNA, 15 bp, Artificial Sequence
  Description of Artificial Sequence: Synthetic oligonucleotide
gcccaacagctcatt

SEQ ID NO: 2194 - DNA, 15 bp, Artificial Sequence
  Description of Artificial Sequence: Synthetic oligonucleotide
gccatcccgtctggg

SEQ ID NO: 2195 - DNA, 15 bp, Artificial Sequence
  Description of Artificial Sequence: Synthetic oligonucleotide
ccttctctccactat

SEQ ID NO: 2196 - DNA, 15 bp, Artificial Sequence
  Description of Artificial Sequence: Synthetic oligonucleotide
ctgcctcagcctgcc

SEQ ID NO: 2197 - DNA, 15 bp, Artificial Sequence
  Description of Artificial Sequence: Synthetic oligonucleotide
tcattggggatgggc

SEQ ID NO: 2198 - DNA, 15 bp, Artificial Sequence
  Description of Artificial Sequence: Synthetic oligonucleotide
ccgccccgtccggga

SEQ ID NO: 2199 - DNA, 15 bp, Artificial Sequence
  Description of Artificial Sequence: Synthetic oligonucleotide
aaggcgggaaaggtg

SEQ ID NO: 2200 - DNA, 15 bp, Artificial Sequence
  Description of Artificial Sequence: Synthetic oligonucleotide
cgtttttttttggtg

SEQ ID NO: 2201 - DNA, 15 bp, Artificial Sequence
  Description of Artificial Sequence: Synthetic oligonucleotide
ccccaaccccgtgct

SEQ ID NO: 2202 - DNA, 15 bp, Artificial Sequence
  Description of Artificial Sequence: Synthetic oligonucleotide
gtctcgttcactcag

SEQ ID NO: 2203 - DNA, 15 bp, Artificial Sequence
  Description of Artificial Sequence: Synthetic oligonucleotide
tggggagcacctctg

SEQ ID NO: 2204 - DNA, 15 bp, Artificial Sequence
  Description of Artificial Sequence: Synthetic oligonucleotide
ctgaccttctctcca

SEQ ID NO: 2205 - DNA, 15 bp, Artificial Sequence
  Description of Artificial Sequence: Synthetic oligonucleotide
ggccgccccttctgg

SEQ ID NO: 2206 - DNA, 15 bp, Artificial Sequence
  Description of Artificial Sequence: Synthetic oligonucleotide
gactggttttcgttt

SEQ ID NO: 2207 - DNA, 15 bp, Artificial Sequence
  Description of Artificial Sequence: Synthetic oligonucleotide
atgacgatggcggtt

SEQ ID NO: 2208 - DNA, 15 bp, Artificial Sequence
  Description of Artificial Sequence: Synthetic oligonucleotide
agtgctcaatgttgc

SEQ ID NO: 2209 - DNA, 15 bp, Artificial Sequence
  Description of Artificial Sequence: Synthetic oligonucleotide
tggattaagggcggt

SEQ ID NO: 2210 - DNA, 15 bp, Artificial Sequence
  Description of Artificial Sequence: Synthetic oligonucleotide
ctgcctggctgccca

SEQ ID NO: 2211 - DNA, 15 bp, Artificial Sequence
  Description of Artificial Sequence: Synthetic oligonucleotide
tttgtggaatagaaa

SEQ ID NO: 2212 - DNA, 15 bp, Artificial Sequence
  Description of Artificial Sequence: Synthetic oligonucleotide
gtgggggggtcagcc

SEQ ID NO: 2213 - DNA, 15 bp, Artificial Sequence
  Description of Artificial Sequence: Synthetic oligonucleotide
cttgggatgctgttg

SEQ ID NO: 2214 - DNA, 15 bp, Artificial Sequence
  Description of Artificial Sequence: Synthetic oligonucleotide
cttgggatgctgtta

SEQ ID NO: 2215 - DNA, 15 bp, Artificial Sequence
  Description of Artificial Sequence: Synthetic oligonucleotide
agatcagattgttac

SEQ ID NO: 2216 - DNA, 15 bp, Artificial Sequence
  Description of Artificial Sequence: Synthetic oligonucleotide
gcctggctgcccagt

SEQ ID NO: 2217 - DNA, 15 bp, Artificial Sequence
  Description of Artificial Sequence: Synthetic oligonucleotide
tcgggctccagtgat

SEQ ID NO: 2218 - DNA, 15 bp, Artificial Sequence
  Description of Artificial Sequence: Synthetic oligonucleotide
ctttgtggaatagaa

SEQ ID NO: 2219 - DNA, 15 bp, Artificial Sequence
  Description of Artificial Sequence: Synthetic oligonucleotide
taaatggattaaggg

SEQ ID NO: 2220 - DNA, 15 bp, Artificial Sequence
  Description of Artificial Sequence: Synthetic oligonucleotide
tcggctcactgcaac

SEQ ID NO: 2221 - DNA, 15 bp, Artificial Sequence
  Description of Artificial Sequence: Synthetic oligonucleotide
ctcatgcggagccga

SEQ ID NO: 2222 - DNA, 15 bp, Artificial Sequence
  Description of Artificial Sequence: Synthetic oligonucleotide
gctacaaccacctcc

SEQ ID NO: 2223 - DNA, 15 bp, Artificial Sequence
  Description of Artificial Sequence: Synthetic oligonucleotide
ctgcctcggcctgcc

SEQ ID NO: 2224 - DNA, 15 bp, Artificial Sequence
  Description of Artificial Sequence: Synthetic oligonucleotide
cggccagccgccccg

SEQ ID NO: 2225 - DNA, 15 bp, Artificial Sequence
  Description of Artificial Sequence: Synthetic oligonucleotide
ttgatctgtgacctt

SEQ ID NO: 2226 - DNA, 15 bp, Artificial Sequence
  Description of Artificial Sequence: Synthetic oligonucleotide
agaaatcggattgtt

SEQ ID NO: 2227 - DNA, 15 bp, Artificial Sequence
  Description of Artificial Sequence: Synthetic oligonucleotide
aacacccaagaatta

SEQ ID NO: 2228 - DNA, 15 bp, Artificial Sequence
  Description of Artificial Sequence: Synthetic oligonucleotide
cgccatcccgtctag

SEQ ID NO: 2229 - DNA, 15 bp, Artificial Sequence
  Description of Artificial Sequence: Synthetic oligonucleotide
gatgcttgaaggcag

SEQ ID NO: 2230 - DNA, 15 bp, Artificial Sequence
  Description of Artificial Sequence: Synthetic oligonucleotide
ggctcgctgcaacct

SEQ ID NO: 2231 - DNA, 15 bp, Artificial Sequence
  Description of Artificial Sequence: Synthetic oligonucleotide
gatagagaaatcgga

SEQ ID NO: 2232 - DNA, 15 bp, Artificial Sequence
  Description of Artificial Sequence: Synthetic oligonucleotide
tccgggaggtggggg

SEQ ID NO: 2233 - DNA, 15 bp, Artificial Sequence
  Description of Artificial Sequence: Synthetic oligonucleotide
gagacggggtttcgc

SEQ ID NO: 2234 - DNA, 15 bp, Artificial Sequence
  Description of Artificial Sequence: Synthetic oligonucleotide
tgccttgggatgctg

SEQ ID NO: 2235 - DNA, 15 bp, Artificial Sequence
  Description of Artificial Sequence: Synthetic oligonucleotide
gagcgcctccgcccg

SEQ ID NO: 2236 - DNA, 15 bp, Artificial Sequence
  Description of Artificial Sequence: Synthetic oligonucleotide
ctgggaggtgagggg

SEQ ID NO: 2237 - DNA, 15 bp, Artificial Sequence
  Description of Artificial Sequence: Synthetic oligonucleotide
tgtagaaagaggtag

SEQ ID NO: 2238 - DNA, 15 bp, Artificial Sequence
  Description of Artificial Sequence: Synthetic oligonucleotide
atccccctctgcgag

SEQ ID NO: 2239 - DNA, 15 bp, Artificial Sequence
  Description of Artificial Sequence: Synthetic oligonucleotide
gccatgatgacaatg

SEQ ID NO: 2240 - DNA, 15 bp, Artificial Sequence
  Description of Artificial Sequence: Synthetic oligonucleotide
aatcggatggttgcc

SEQ ID NO: 2241 - DNA, 15 bp, Artificial Sequence
  Description of Artificial Sequence: Synthetic oligonucleotide
taaaaaaaattaaaa

SEQ ID NO: 2242 - DNA, 15 bp, Artificial Sequence
  Description of Artificial Sequence: Synthetic oligonucleotide
cctctgatgccgagc

SEQ ID NO: 2243 - DNA, 15 bp, Artificial Sequence
  Description of Artificial Sequence: Synthetic oligonucleotide
tttgttcacgtgttt

SEQ ID NO: 2244 - DNA, 15 bp, Artificial Sequence
  Description of Artificial Sequence: Synthetic oligonucleotide
gcgcctccgcccggc

SEQ ID NO: 2245 - DNA, 15 bp, Artificial Sequence
  Description of Artificial Sequence: Synthetic oligonucleotide
cccggccagccgccc

SEQ ID NO: 2246 - DNA, 15 bp, Artificial Sequence
  Description of Artificial Sequence: Synthetic oligonucleotide
tccccctctccgaga

SEQ ID NO: 2247 - DNA, 15 bp, Artificial Sequence
  Description of Artificial Sequence: Synthetic oligonucleotide
aagtagacataggag

SEQ ID NO: 2248 - DNA, 15 bp, Artificial Sequence
  Description of Artificial Sequence: Synthetic oligonucleotide
gacggagtctcgttc

SEQ ID NO: 2249 - DNA, 15 bp, Artificial Sequence
  Description of Artificial Sequence: Synthetic oligonucleotide
tgccgggattgcaga

SEQ ID NO: 2250 - DNA, 15 bp, Artificial Sequence
  Description of Artificial Sequence: Synthetic oligonucleotide
ggtgctgggattgca

SEQ ID NO: 2251 - DNA, 15 bp, Artificial Sequence
  Description of Artificial Sequence: Synthetic oligonucleotide
ctcagtgctcaatgt

SEQ ID NO: 2252 - DNA, 15 bp, Artificial Sequence
  Description of Artificial Sequence: Synthetic oligonucleotide
gtcgaaaagaaaagg

SEQ ID NO: 2253 - DNA, 15 bp, Artificial Sequence
  Description of Artificial Sequence: Synthetic oligonucleotide
tggggaaaagaaaga

SEQ ID NO: 2254 - DNA, 15 bp, Artificial Sequence
  Description of Artificial Sequence: Synthetic oligonucleotide
tggggaaaaaattga

SEQ ID NO: 2255 - DNA, 15 bp, Artificial Sequence
  Description of Artificial Sequence: Synthetic oligonucleotide
tttttggtggagacg

SEQ ID NO: 2256 - DNA, 15 bp, Artificial Sequence
  Description of Artificial Sequence: Synthetic oligonucleotide
aataaaaaaaaaaaa

SEQ ID NO: 2257 - DNA, 15 bp, Artificial Sequence
  Description of Artificial Sequence: Synthetic oligonucleotide
agcatgctcgttaag

SEQ ID NO: 2258 - DNA, 15 bp, Artificial Sequence
  Description of Artificial Sequence: Synthetic oligonucleotide
cggccgcccctactg

SEQ ID NO: 2259 - DNA, 15 bp, Artificial Sequence
  Description of Artificial Sequence: Synthetic oligonucleotide
agaattatcaataaa

SEQ ID NO: 2260 - DNA, 15 bp, Artificial Sequence
  Description of Artificial Sequence: Synthetic oligonucleotide
taaacagatgcttga

SEQ ID NO: 2261 - DNA, 15 bp, Artificial Sequence
  Description of Artificial Sequence: Synthetic oligonucleotide
ctgggatgtgaggag

SEQ ID NO: 2262 - DNA, 15 bp, Artificial Sequence
  Description of Artificial Sequence: Synthetic oligonucleotide
cttggcctcccaaag

SEQ ID NO: 2263 - DNA, 15 bp, Artificial Sequence
  Description of Artificial Sequence: Synthetic oligonucleotide
gacgatggcggtttt

SEQ ID NO: 2264 - DNA, 15 bp, Artificial Sequence
  Description of Artificial Sequence: Synthetic oligonucleotide
ttgtcgaatagaaaa

SEQ ID NO: 2265 - DNA, 15 bp, Artificial Sequence
  Description of Artificial Sequence: Synthetic oligonucleotide
gcccggccgcccatc

SEQ ID NO: 2266 - DNA, 15 bp, Artificial Sequence
  Description of Artificial Sequence: Synthetic oligonucleotide
cggaaggccgcaggg

SEQ ID NO: 2267 - DNA, 15 bp, Artificial Sequence
  Description of Artificial Sequence: Synthetic oligonucleotide
ccatgaccctgccaa

SEQ ID NO: 2268 - DNA, 15 bp, Artificial Sequence
  Description of Artificial Sequence: Synthetic oligonucleotide
actattgtcctatga

SEQ ID NO: 2269 - DNA, 15 bp, Artificial Sequence
  Description of Artificial Sequence: Synthetic oligonucleotide
ctctgcctggctgcc

SEQ ID NO: 2270 - DNA, 15 bp, Artificial Sequence
  Description of Artificial Sequence: Synthetic oligonucleotide
gtgcaagatgtgctt

SEQ ID NO: 2271 - DNA, 15 bp, Artificial Sequence
  Description of Artificial Sequence: Synthetic oligonucleotide
gattgttgctgtgtc

SEQ ID NO: 2272 - DNA, 15 bp, Artificial Sequence
  Description of Artificial Sequence: Synthetic oligonucleotide
cctctgcccggccac

SEQ ID NO: 2273 - DNA, 15 bp, Artificial Sequence
  Description of Artificial Sequence: Synthetic oligonucleotide
ctacaacctacacct

SEQ ID NO: 2274 - DNA, 15 bp, Artificial Sequence
  Description of Artificial Sequence: Synthetic oligonucleotide
atcggatggttgccg

SEQ ID NO: 2275 - DNA, 15 bp, Artificial Sequence
  Description of Artificial Sequence: Synthetic oligonucleotide
ctctgcccggccacc

SEQ ID NO: 2276 - DNA, 15 bp, Artificial Sequence
  Description of Artificial Sequence: Synthetic oligonucleotide
tctgaaacatgtgct

SEQ ID NO: 2277 - DNA, 15 bp, Artificial Sequence
  Description of Artificial Sequence: Synthetic oligonucleotide
ccatcccatctagga

SEQ ID NO: 2278 - DNA, 15 bp, Artificial Sequence
  Description of Artificial Sequence: Synthetic oligonucleotide
cccggccgcccagtc

SEQ ID NO: 2279 - DNA, 15 bp, Artificial Sequence
  Description of Artificial Sequence: Synthetic oligonucleotide
ctgcccgcctcggcc

SEQ ID NO: 2280 - DNA, 15 bp, Artificial Sequence
  Description of Artificial Sequence: Synthetic oligonucleotide
ccggccgccatcccg

SEQ ID NO: 2281 - DNA, 15 bp, Artificial Sequence
  Description of Artificial Sequence: Synthetic oligonucleotide
tctgggaggaggtgg

SEQ ID NO: 2282 - DNA, 15 bp, Artificial Sequence
  Description of Artificial Sequence: Synthetic oligonucleotide
gccaccgccccgtct

SEQ ID NO: 2283 - DNA, 15 bp, Artificial Sequence
  Description of Artificial Sequence: Synthetic oligonucleotide
cttgggatcctgttg

SEQ ID NO: 2284 - DNA, 15 bp, Artificial Sequence
  Description of Artificial Sequence: Synthetic oligonucleotide
tgaggagcgtctctg

SEQ ID NO: 2285 - DNA, 15 bp, Artificial Sequence
  Description of Artificial Sequence: Synthetic oligonucleotide
cgcgccgccacgcct

SEQ ID NO: 2286 - DNA, 15 bp, Artificial Sequence
  Description of Artificial Sequence: Synthetic oligonucleotide
gaaggcagcatgctc

SEQ ID NO: 2287 - DNA, 15 bp, Artificial Sequence
  Description of Artificial Sequence: Synthetic oligonucleotide
ccgccatctcggctc

SEQ ID NO: 2288 - DNA, 15 bp, Artificial Sequence
  Description of Artificial Sequence: Synthetic oligonucleotide
cagggttaaatggat

SEQ ID NO: 2289 - DNA, 15 bp, Artificial Sequence
  Description of Artificial Sequence: Synthetic oligonucleotide
ggaggaggtgggggg

SEQ ID NO: 2290 - DNA, 15 bp, Artificial Sequence
  Description of Artificial Sequence: Synthetic oligonucleotide
ctattatcctatgac

SEQ ID NO: 2291 - DNA, 15 bp, Artificial Sequence
  Description of Artificial Sequence: Synthetic oligonucleotide
cgctgtgttggccgg

SEQ ID NO: 2292 - DNA, 15 bp, Artificial Sequence
  Description of Artificial Sequence: Synthetic oligonucleotide
gctcgctacaacctc

SEQ ID NO: 2293 - DNA, 15 bp, Artificial Sequence
  Description of Artificial Sequence: Synthetic oligonucleotide
gctcgctacaaccta

SEQ ID NO: 2294 - DNA, 15 bp, Artificial Sequence
  Description of Artificial Sequence: Synthetic oligonucleotide
tagagaaatcggatt

SEQ ID NO: 2295 - DNA, 15 bp, Artificial Sequence
  Description of Artificial Sequence: Synthetic oligonucleotide
tctgcccgcctcggc

SEQ ID NO: 2296 - DNA, 15 bp, Artificial Sequence
  Description of Artificial Sequence: Synthetic oligonucleotide
aacagctcattgaga

SEQ ID NO: 2297 - DNA, 15 bp, Artificial Sequence
  Description of Artificial Sequence: Synthetic oligonucleotide
ccgtctgggatgtga

SEQ ID NO: 2298 - DNA, 15 bp, Artificial Sequence
  Description of Artificial Sequence: Synthetic oligonucleotide
ctgccgagtgcctgg

SEQ ID NO: 2299 - DNA, 15 bp, Artificial Sequence
  Description of Artificial Sequence: Synthetic oligonucleotide
ggtggggggcgcctc

SEQ ID NO: 2300 - DNA, 15 bp, Artificial Sequence
  Description of Artificial Sequence: Synthetic oligonucleotide
ctctcccctctttct

SEQ ID NO: 2301 - DNA, 15 bp, Artificial Sequence
  Description of Artificial Sequence: Synthetic oligonucleotide
gaacgggccatgatg

SEQ ID NO: 2302 - DNA, 15 bp, Artificial Sequence
  Description of Artificial Sequence: Synthetic oligonucleotide
ggaaggccgcagggt

SEQ ID NO: 2303 - DNA, 15 bp, Artificial Sequence
  Description of Artificial Sequence: Synthetic oligonucleotide
atctgcccgcctcgg

SEQ ID NO: 2304 - DNA, 15 bp, Artificial Sequence
  Description of Artificial Sequence: Synthetic oligonucleotide
acatccccctctccg

SEQ ID NO: 2305 - DNA, 15 bp, Artificial Sequence
  Description of Artificial Sequence: Synthetic oligonucleotide
ctctcccctctttcc

SEQ ID NO: 2306 - DNA, 15 bp, Artificial Sequence
  Description of Artificial Sequence: Synthetic oligonucleotide
agccgccccgtctgg

SEQ ID NO: 2307 - DNA, 15 bp, Artificial Sequence
  Description of Artificial Sequence: Synthetic oligonucleotide
caaagtgctaagatt

SEQ ID NO: 2308 - DNA, 15 bp, Artificial Sequence
  Description of Artificial Sequence: Synthetic oligonucleotide
ggaaggccgcaggga

SEQ ID NO: 2309 - DNA, 15 bp, Artificial Sequence
  Description of Artificial Sequence: Synthetic oligonucleotide
cacggtctccctctc

SEQ ID NO: 2310 - DNA, 15 bp, Artificial Sequence
  Description of Artificial Sequence: Synthetic oligonucleotide
accttatccccaacc

SEQ ID NO: 2311 - DNA, 15 bp, Artificial Sequence
  Description of Artificial Sequence: Synthetic oligonucleotide
ggtgcaagatgtgct

SEQ ID NO: 2312 - DNA, 15 bp, Artificial Sequence
  Description of Artificial Sequence: Synthetic oligonucleotide
acctttgttcacgtg

SEQ ID NO: 2313 - DNA, 15 bp, Artificial Sequence
  Description of Artificial Sequence: Synthetic oligonucleotide
tgtccactcagggtt

SEQ ID NO: 2314 - DNA, 15 bp, Artificial Sequence
  Description of Artificial Sequence: Synthetic oligonucleotide
gccgcagggtcctct

SEQ ID NO: 2315 - DNA, 15 bp, Artificial Sequence
  Description of Artificial Sequence: Synthetic oligonucleotide
ccggccgcccctact

SEQ ID NO: 2316 - DNA, 15 bp, Artificial Sequence
  Description of Artificial Sequence: Synthetic oligonucleotide
tgggaggtgtgccca

SEQ ID NO: 2317 - DNA, 15 bp, Artificial Sequence
  Description of Artificial Sequence: Synthetic oligonucleotide
gcgcgccgccacgcc

SEQ ID NO: 2318 - DNA, 15 bp, Artificial Sequence
  Description of Artificial Sequence: Synthetic oligonucleotide
cctggctgcccagtc

SEQ ID NO: 2319 - DNA, 15 bp, Artificial Sequence
  Description of Artificial Sequence: Synthetic oligonucleotide
ctgggaggaggtggg

SEQ ID NO: 2320 - DNA, 15 bp, Artificial Sequence
  Description of Artificial Sequence: Synthetic oligonucleotide
atctaggaagtgagg

SEQ ID NO: 2321 - DNA, 15 bp, Artificial Sequence
  Description of Artificial Sequence: Synthetic oligonucleotide
gtgcccaacagctca

SEQ ID NO: 2322 - DNA, 15 bp, Artificial Sequence
  Description of Artificial Sequence: Synthetic oligonucleotide
actcagtgctcaatg

SEQ ID NO: 2323 - DNA, 15 bp, Artificial Sequence
  Description of Artificial Sequence: Synthetic oligonucleotide
atgtgctgtgtcaac

SEQ ID NO: 2324 - DNA, 15 bp, Artificial Sequence
  Description of Artificial Sequence: Synthetic oligonucleotide
ccgccccgtctggga

SEQ ID NO: 2325 - DNA, 15 bp, Artificial Sequence
  Description of Artificial Sequence: Synthetic oligonucleotide
gtctggttcactcag

SEQ ID NO: 2326 - DNA, 15 bp, Artificial Sequence
  Description of Artificial Sequence: Synthetic oligonucleotide
tgtgtagaaagaagt

SEQ ID NO: 2327 - DNA, 15 bp, Artificial Sequence
  Description of Artificial Sequence: Synthetic oligonucleotide
tttttttttggtgga

SEQ ID NO: 2328 - DNA, 15 bp, Artificial Sequence
  Description of Artificial Sequence: Synthetic oligonucleotide
aaagaagtagacata

SEQ ID NO: 2329 - DNA, 15 bp, Artificial Sequence
  Description of Artificial Sequence: Synthetic oligonucleotide
ccatcccgtctagga

SEQ ID NO: 2330 - DNA, 15 bp, Artificial Sequence
  Description of Artificial Sequence: Synthetic oligonucleotide
aaagaagtagacatg

SEQ ID NO: 2331 - DNA, 15 bp, Artificial Sequence
  Description of Artificial Sequence: Synthetic oligonucleotide
gcccggccgccccta

SEQ ID NO: 2332 - DNA, 15 bp, Artificial Sequence
  Description of Artificial Sequence: Synthetic oligonucleotide
gagaaatcggattgt

SEQ ID NO: 2333 - DNA, 15 bp, Artificial Sequence
  Description of Artificial Sequence: Synthetic oligonucleotide
ccctctcccctcttt

SEQ ID NO: 2334 - DNA, 15 bp, Artificial Sequence
  Description of Artificial Sequence: Synthetic oligonucleotide
gatgtgctttgttaa

SEQ ID NO: 2335 - DNA, 15 bp, Artificial Sequence
  Description of Artificial Sequence: Synthetic oligonucleotide
atcagattgttactg

SEQ ID NO: 2336 - DNA, 15 bp, Artificial Sequence
  Description of Artificial Sequence: Synthetic oligonucleotide
gtgaggggcgcctct

SEQ ID NO: 2337 - DNA, 15 bp, Artificial Sequence
  Description of Artificial Sequence: Synthetic oligonucleotide
gaaagaagtagacat

SEQ ID NO: 2338 - DNA, 15 bp, Artificial Sequence
  Description of Artificial Sequence: Synthetic oligonucleotide
ctgcctcgggctcca

SEQ ID NO: 2339 - DNA, 15 bp, Artificial Sequence
  Description of Artificial Sequence: Synthetic oligonucleotide
tatttttggtggaga

SEQ ID NO: 2340 - DNA, 15 bp, Artificial Sequence
  Description of Artificial Sequence: Synthetic oligonucleotide
ccgcccatcgtctgg

SEQ ID NO: 2341 - DNA, 15 bp, Artificial Sequence
  Description of Artificial Sequence: Synthetic oligonucleotide
catctcggctcactg

SEQ ID NO: 2342 - DNA, 15 bp, Artificial Sequence
  Description of Artificial Sequence: Synthetic oligonucleotide
gactggtttttgtat

SEQ ID NO: 2343 - DNA, 15 bp, Artificial Sequence
  Description of Artificial Sequence: Synthetic oligonucleotide
aaaggtggggaaaag

SEQ ID NO: 2344 - DNA, 15 bp, Artificial Sequence
  Description of Artificial Sequence: Synthetic oligonucleotide
gatgacaatggcggc

SEQ ID NO: 2345 - DNA, 15 bp, Artificial Sequence
  Description of Artificial Sequence: Synthetic oligonucleotide
ctgggaggtgtaccc

SEQ ID NO: 2346 - DNA, 15 bp, Artificial Sequence
  Description of Artificial Sequence: Synthetic oligonucleotide
ggaatagaaaggggg

SEQ ID NO: 2347 - DNA, 15 bp, Artificial Sequence
  Description of Artificial Sequence: Synthetic oligonucleotide
gaaaaattcttctgc

SEQ ID NO: 2348 - DNA, 15 bp, Artificial Sequence
  Description of Artificial Sequence: Synthetic oligonucleotide
gatgacaatggcggt

SEQ ID NO: 2349 - DNA, 15 bp, Artificial Sequence
  Description of Artificial Sequence: Synthetic oligonucleotide
ctgcgagaaacaccc

SEQ ID NO: 2350 - DNA, 15 bp, Artificial Sequence
  Description of Artificial Sequence: Synthetic oligonucleotide
cctctcccctctctc

SEQ ID NO: 2351 - DNA, 15 bp, Artificial Sequence
  Description of Artificial Sequence: Synthetic oligonucleotide
acttttcattttgtt

SEQ ID NO: 2352 - DNA, 15 bp, Artificial Sequence
  Description of Artificial Sequence: Synthetic oligonucleotide
ctcagcctgccgagt

SEQ ID NO: 2353 - DNA, 15 bp, Artificial Sequence
  Description of Artificial Sequence: Synthetic oligonucleotide
ctcactcagtgctca

SEQ ID NO: 2354 - DNA, 15 bp, Artificial Sequence
  Description of Artificial Sequence: Synthetic oligonucleotide
gcagacggagtctgg

SEQ ID NO: 2355 - DNA, 15 bp, Artificial Sequence
  Description of Artificial Sequence: Synthetic oligonucleotide
ctctgccccgccgcc

SEQ ID NO: 2356 - DNA, 15 bp, Artificial Sequence
  Description of Artificial Sequence: Synthetic oligonucleotide
cacatgtttatctgc

SEQ ID NO: 2357 - DNA, 15 bp, Artificial Sequence
  Description of Artificial Sequence: Synthetic oligonucleotide
gttttggtggagacg

SEQ ID NO: 2358 - DNA, 15 bp, Artificial Sequence
  Description of Artificial Sequence: Synthetic oligonucleotide
ctcattggggatggg

SEQ ID NO: 2359 - DNA, 15 bp, Artificial Sequence
  Description of Artificial Sequence: Synthetic oligonucleotide
atccccctctgtgag

SEQ ID NO: 2360 - DNA, 15 bp, Artificial Sequence
  Description of Artificial Sequence: Synthetic oligonucleotide
gcccggccgccatcc

SEQ ID NO: 2361 - DNA, 15 bp, Artificial Sequence
  Description of Artificial Sequence: Synthetic oligonucleotide
tgtattttttggtgg

SEQ ID NO: 2362 - DNA, 15 bp, Artificial Sequence
  Description of Artificial Sequence: Synthetic oligonucleotide
ggcagcatgctcgtt

SEQ ID NO: 2363 - DNA, 15 bp, Artificial Sequence
  Description of Artificial Sequence: Synthetic oligonucleotide
ccagcggctcattgg

SEQ ID NO: 2364 - DNA, 15 bp, Artificial Sequence
  Description of Artificial Sequence: Synthetic oligonucleotide
gggggaaatgtgggg

SEQ ID NO: 2365 - DNA, 15 bp, Artificial Sequence
  Description of Artificial Sequence: Synthetic oligonucleotide
aggtggggggcgcct

SEQ ID NO: 2366 - DNA, 15 bp, Artificial Sequence
  Description of Artificial Sequence: Synthetic oligonucleotide
tcggcctgccgagtg

SEQ ID NO: 2367 - DNA, 15 bp, Artificial Sequence
  Description of Artificial Sequence: Synthetic oligonucleotide
cgggccggtctccag

SEQ ID NO: 2368 - DNA, 15 bp, Artificial Sequence
  Description of Artificial Sequence: Synthetic oligonucleotide
aagaaagagagatca

SEQ ID NO: 2369 - DNA, 15 bp, Artificial Sequence
  Description of Artificial Sequence: Synthetic oligonucleotide
ctaggaaaaccagag

SEQ ID NO: 2370 - DNA, 15 bp, Artificial Sequence
  Description of Artificial Sequence: Synthetic oligonucleotide
cgccgccccgtctgg

SEQ ID NO: 2371 - DNA, 15 bp, Artificial Sequence
  Description of Artificial Sequence: Synthetic oligonucleotide
ccctctgcctggctg

SEQ ID NO: 2372 - DNA, 15 bp, Artificial Sequence
  Description of Artificial Sequence: Synthetic oligonucleotide
ggggcgcctctgccc

SEQ ID NO: 2373 - DNA, 15 bp, Artificial Sequence
  Description of Artificial Sequence: Synthetic oligonucleotide
tgttcacttgtttat

SEQ ID NO: 2374 - DNA, 15 bp, Artificial Sequence
  Description of Artificial Sequence: Synthetic oligonucleotide
cttccctccactatt

SEQ ID NO: 2375 - DNA, 15 bp, Artificial Sequence
  Description of Artificial Sequence: Synthetic oligonucleotide
actaaaaaaaaaaaa

SEQ ID NO: 2376 - DNA, 15 bp, Artificial Sequence
  Description of Artificial Sequence: Synthetic oligonucleotide
aatggattaagggcg

SEQ ID NO: 2377 - DNA, 15 bp, Artificial Sequence
  Description of Artificial Sequence: Synthetic oligonucleotide
ctccctgcctgattc

SEQ ID NO: 2378 - DNA, 15 bp, Artificial Sequence
  Description of Artificial Sequence: Synthetic oligonucleotide
gatgctgttaatcta

SEQ ID NO: 2379 - DNA, 15 bp, Artificial Sequence
  Description of Artificial Sequence: Synthetic oligonucleotide
gaaaggcgggaaagg

SEQ ID NO: 2380 - DNA, 15 bp, Artificial Sequence
  Description of Artificial Sequence: Synthetic oligonucleotide
accccgtctgggaag

SEQ ID NO: 2381 - DNA, 15 bp, Artificial Sequence
  Description of Artificial Sequence: Synthetic oligonucleotide
ctggcctcgagtgat

SEQ ID NO: 2382 - DNA, 15 bp, Artificial Sequence
  Description of Artificial Sequence: Synthetic oligonucleotide
cgccgtgttggccgg

SEQ ID NO: 2383 - DNA, 15 bp, Artificial Sequence
  Description of Artificial Sequence: Synthetic oligonucleotide
cccagcggctcattg

SEQ ID NO: 2384 - DNA, 15 bp, Artificial Sequence
  Description of Artificial Sequence: Synthetic oligonucleotide
gtgctaagattgcag

SEQ ID NO: 2385 - DNA, 15 bp, Artificial Sequence
  Description of Artificial Sequence: Synthetic oligonucleotide
agggacacaaacact

SEQ ID NO: 2386 - DNA, 15 bp, Artificial Sequence
  Description of Artificial Sequence: Synthetic oligonucleotide
atgctcgttaagagt

SEQ ID NO: 2387 - DNA, 15 bp, Artificial Sequence
  Description of Artificial Sequence: Synthetic oligonucleotide
aggtgtgcccaacag

SEQ ID NO: 2388 - DNA, 15 bp, Artificial Sequence
  Description of Artificial Sequence: Synthetic oligonucleotide
ttttgtcgaaaagaa

SEQ ID NO: 2389 - DNA, 15 bp, Artificial Sequence
  Description of Artificial Sequence: Synthetic oligonucleotide
cggccgcccagtctg

SEQ ID NO: 2390 - DNA, 15 bp, Artificial Sequence
  Description of Artificial Sequence: Synthetic oligonucleotide
ctctgatgccgagcc

SEQ ID NO: 2391 - DNA, 15 bp, Artificial Sequence
  Description of Artificial Sequence: Synthetic oligonucleotide
ccttgggatgctgtt

SEQ ID NO: 2392 - DNA, 15 bp, Artificial Sequence
  Description of Artificial Sequence: Synthetic oligonucleotide
ctccctaatcttaag

SEQ ID NO: 2393 - DNA, 15 bp, Artificial Sequence
  Description of Artificial Sequence: Synthetic oligonucleotide
atccccctctccgag

SEQ ID NO: 2394 - DNA, 15 bp, Artificial Sequence
  Description of Artificial Sequence: Synthetic oligonucleotide
gcctggccgcccagt

SEQ ID NO: 2395 - DNA, 15 bp, Artificial Sequence
  Description of Artificial Sequence: Synthetic oligonucleotide
ttgagaaatcggatg

SEQ ID NO: 2396 - DNA, 15 bp, Artificial Sequence
  Description of Artificial Sequence: Synthetic oligonucleotide
agaaagaagtagaca

SEQ ID NO: 2397 - DNA, 15 bp, Artificial Sequence
  Description of Artificial Sequence: Synthetic oligonucleotide
gcccggccgccaccc

SEQ ID NO: 2398 - DNA, 15 bp, Artificial Sequence
  Description of Artificial Sequence: Synthetic oligonucleotide
cccgaggtgctggga

SEQ ID NO: 2399 - DNA, 15 bp, Artificial Sequence
  Description of Artificial Sequence: Synthetic oligonucleotide
ggggggcgcctctgc

SEQ ID NO: 2400 - DNA, 15 bp, Artificial Sequence
  Description of Artificial Sequence: Synthetic oligonucleotide
gtggatagaagtaga

SEQ ID NO: 2401 - DNA, 15 bp, Artificial Sequence
  Description of Artificial Sequence: Synthetic oligonucleotide
ccggccgcccatcgt

SEQ ID NO: 2402 - DNA, 15 bp, Artificial Sequence
  Description of Artificial Sequence: Synthetic oligonucleotide
tctcaagtacccagg

SEQ ID NO: 2403 - DNA, 15 bp, Artificial Sequence
  Description of Artificial Sequence: Synthetic oligonucleotide
tttcgtttttttttg

SEQ ID NO: 2404 - DNA, 15 bp, Artificial Sequence
  Description of Artificial Sequence: Synthetic oligonucleotide
gtttcgccgtgttgg

SEQ ID NO: 2405 - DNA, 15 bp, Artificial Sequence
  Description of Artificial Sequence: Synthetic oligonucleotide
cggctcgctgcaacc

SEQ ID NO: 2406 - DNA, 15 bp, Artificial Sequence
  Description of Artificial Sequence: Synthetic oligonucleotide
ccgtgctctctgaaa

SEQ ID NO: 2407 - DNA, 15 bp, Artificial Sequence
  Description of Artificial Sequence: Synthetic oligonucleotide
gcctgactggttttg

SEQ ID NO: 2408 - DNA, 15 bp, Artificial Sequence
  Description of Artificial Sequence: Synthetic oligonucleotide
gcctgactggttttc

SEQ ID NO: 2409 - DNA, 15 bp, Artificial Sequence
  Description of Artificial Sequence: Synthetic oligonucleotide
gttaaacagatgctt

SEQ ID NO: 2410 - DNA, 15 bp, Artificial Sequence
  Description of Artificial Sequence: Synthetic oligonucleotide
ggagactccattttg

SEQ ID NO: 2411 - DNA, 15 bp, Artificial Sequence
  Description of Artificial Sequence: Synthetic oligonucleotide
gccgggctggtctcc

SEQ ID NO: 2412 - DNA, 15 bp, Artificial Sequence
  Description of Artificial Sequence: Synthetic oligonucleotide
gcctgactggttttt

SEQ ID NO: 2413 - DNA, 15 bp, Artificial Sequence
  Description of Artificial Sequence: Synthetic oligonucleotide
agaaaggggggaaag

SEQ ID NO: 2414 - DNA, 15 bp, Artificial Sequence
  Description of Artificial Sequence: Synthetic oligonucleotide
ggatgctgttaatct

SEQ ID NO: 2415 - DNA, 15 bp, Artificial Sequence
  Description of Artificial Sequence: Synthetic oligonucleotide
tccagtgattctcct

SEQ ID NO: 2416 - DNA, 15 bp, Artificial Sequence
  Description of Artificial Sequence: Synthetic oligonucleotide
gaagtagacatggga

SEQ ID NO: 2417 - DNA, 15 bp, Artificial Sequence
  Description of Artificial Sequence: Synthetic oligonucleotide
ttcgtttttttttgg

SEQ ID NO: 2418 - DNA, 15 bp, Artificial Sequence
  Description of Artificial Sequence: Synthetic oligonucleotide
ccccgtctgggatgt

SEQ ID NO: 2419 - DNA, 15 bp, Artificial Sequence
  Description of Artificial Sequence: Synthetic oligonucleotide
tactgctgccatctc

SEQ ID NO: 2420 - DNA, 15 bp, Artificial Sequence
  Description of Artificial Sequence: Synthetic oligonucleotide
aggtgggggggtcag

SEQ ID NO: 2421 - DNA, 15 bp, Artificial Sequence
  Description of Artificial Sequence: Synthetic oligonucleotide
gattgcagacggagt

SEQ ID NO: 2422 - DNA, 15 bp, Artificial Sequence
  Description of Artificial Sequence: Synthetic oligonucleotide
caggatgacaatggc

SEQ ID NO: 2423 - DNA, 15 bp, Artificial Sequence
  Description of Artificial Sequence: Synthetic oligonucleotide
actattgtcccatga

SEQ ID NO: 2424 - DNA, 15 bp, Artificial Sequence
  Description of Artificial Sequence: Synthetic oligonucleotide
agctcctaaccgcga

SEQ ID NO: 2425 - DNA, 15 bp, Artificial Sequence
  Description of Artificial Sequence: Synthetic oligonucleotide
cgattgcaggcacgc

SEQ ID NO: 2426 - DNA, 15 bp, Artificial Sequence
  Description of Artificial Sequence: Synthetic oligonucleotide
tccctctcccctctc

SEQ ID NO: 2427 - DNA, 15 bp, Artificial Sequence
  Description of Artificial Sequence: Synthetic oligonucleotide
ccattgagaacgggc

SEQ ID NO: 2428 - DNA, 15 bp, Artificial Sequence
  Description of Artificial Sequence: Synthetic oligonucleotide
gttcacgtgtttatc

SEQ ID NO: 2429 - DNA, 15 bp, Artificial Sequence
  Description of Artificial Sequence: Synthetic oligonucleotide
tccctctcccctctt

SEQ ID NO: 2430 - DNA, 15 bp, Artificial Sequence
  Description of Artificial Sequence: Synthetic oligonucleotide
gactgtactgccgtg

SEQ ID NO: 2431 - DNA, 15 bp, Artificial Sequence
  Description of Artificial Sequence: Synthetic oligonucleotide
atcctatgaccctgc

SEQ ID NO: 2432 - DNA, 15 bp, Artificial Sequence
  Description of Artificial Sequence: Synthetic oligonucleotide
ttgggatcctgttga

SEQ ID NO: 2433 - DNA, 15 bp, Artificial Sequence
  Description of Artificial Sequence: Synthetic oligonucleotide
tcggcctcccgaggt

SEQ ID NO: 2434 - DNA, 15 bp, Artificial Sequence
  Description of Artificial Sequence: Synthetic oligonucleotide
tgtcaactcagggtt

SEQ ID NO: 2435 - DNA, 15 bp, Artificial Sequence
  Description of Artificial Sequence: Synthetic oligonucleotide
cttacccccaaccct

SEQ ID NO: 2436 - DNA, 15 bp, Artificial Sequence
  Description of Artificial Sequence: Synthetic oligonucleotide
tgctcgttaagagtc

SEQ ID NO: 2437 - DNA, 15 bp, Artificial Sequence
  Description of Artificial Sequence: Synthetic oligonucleotide
agggtggggaaaaaa

SEQ ID NO: 2438 - DNA, 15 bp, Artificial Sequence
  Description of Artificial Sequence: Synthetic oligonucleotide
ctcaatggtgcccag

SEQ ID NO: 2439 - DNA, 15 bp, Artificial Sequence
  Description of Artificial Sequence: Synthetic oligonucleotide
tttccacggtctccc

SEQ ID NO: 2440 - DNA, 15 bp, Artificial Sequence
  Description of Artificial Sequence: Synthetic oligonucleotide
gccgtgtctgtgtag

SEQ ID NO: 2441 - DNA, 15 bp, Artificial Sequence
  Description of Artificial Sequence: Synthetic oligonucleotide
ggatcctgttgatct

SEQ ID NO: 2442 - DNA, 15 bp, Artificial Sequence
  Description of Artificial Sequence: Synthetic oligonucleotide
tccctgcctgattct

SEQ ID NO: 2443 - DNA, 15 bp, Artificial Sequence
  Description of Artificial Sequence: Synthetic oligonucleotide
ctccctctgttgccg

SEQ ID NO: 2444 - DNA, 15 bp, Artificial Sequence
  Description of Artificial Sequence: Synthetic oligonucleotide
aggagcgcctctgcc

SEQ ID NO: 2445 - DNA, 15 bp, Artificial Sequence
  Description of Artificial Sequence: Synthetic oligonucleotide
agaaaggcgggaagg

SEQ ID NO: 2446 - DNA, 15 bp, Artificial Sequence
  Description of Artificial Sequence: Synthetic oligonucleotide
gccgccccgtctggg

SEQ ID NO: 2447 - DNA, 15 bp, Artificial Sequence
  Description of Artificial Sequence: Synthetic oligonucleotide
ccgtctgggaggtgg

SEQ ID NO: 2448 - DNA, 15 bp, Artificial Sequence
  Description of Artificial Sequence: Synthetic oligonucleotide
ccgtctgggaagtga

SEQ ID NO: 2449 - DNA, 15 bp, Artificial Sequence
  Description of Artificial Sequence: Synthetic oligonucleotide
gacggggtttcgctg

SEQ ID NO: 2450 - DNA, 15 bp, Artificial Sequence
  Description of Artificial Sequence: Synthetic oligonucleotide
cagtgctcaatggtg

SEQ ID NO: 2451 - DNA, 15 bp, Artificial Sequence
  Description of Artificial Sequence: Synthetic oligonucleotide
tcctgaccgcgagtg

SEQ ID NO: 2452 - DNA, 15 bp, Artificial Sequence
  Description of Artificial Sequence: Synthetic oligonucleotide
cctccactattgtcc

SEQ ID NO: 2453 - DNA, 15 bp, Artificial Sequence
  Description of Artificial Sequence: Synthetic oligonucleotide
tgtctgtgtagaaag

SEQ ID NO: 2454 - DNA, 15 bp, Artificial Sequence
  Description of Artificial Sequence: Synthetic oligonucleotide
ctgtgtggatagaag

SEQ ID NO: 2455 - DNA, 15 bp, Artificial Sequence
  Description of Artificial Sequence: Synthetic oligonucleotide
ggaggtggggggcgc

SEQ ID NO: 2456 - DNA, 15 bp, Artificial Sequence
  Description of Artificial Sequence: Synthetic oligonucleotide
gcgattgcaggcacg

SEQ ID NO: 2457 - DNA, 15 bp, Artificial Sequence
  Description of Artificial Sequence: Synthetic oligonucleotide
tttgttctgtactaa

SEQ ID NO: 2458 - DNA, 15 bp, Artificial Sequence
  Description of Artificial Sequence: Synthetic oligonucleotide
gacttttcattttgt

SEQ ID NO: 2459 - DNA, 15 bp, Artificial Sequence
  Description of Artificial Sequence: Synthetic oligonucleotide
ccagctcctaaccgc

SEQ ID NO: 2460 - DNA, 15 bp, Artificial Sequence
  Description of Artificial Sequence: Synthetic oligonucleotide
gccgcccctactggg

SEQ ID NO: 2461 - DNA, 15 bp, Artificial Sequence
  Description of Artificial Sequence: Synthetic oligonucleotide
tggcctcccaaagag

SEQ ID NO: 2462 - DNA, 15 bp, Artificial Sequence
  Description of Artificial Sequence: Synthetic oligonucleotide
gtctgagatgtgggg

SEQ ID NO: 2463 - DNA, 15 bp, Artificial Sequence
  Description of Artificial Sequence: Synthetic oligonucleotide
gaggagcgtctctgc

SEQ ID NO: 2464 - DNA, 15 bp, Artificial Sequence
  Description of Artificial Sequence: Synthetic oligonucleotide
ctctgtgagaaacac

SEQ ID NO: 2465 - DNA, 15 bp, Artificial Sequence
  Description of Artificial Sequence: Synthetic oligonucleotide
ttgaaggcagcatgc

SEQ ID NO: 2466 - DNA, 15 bp, Artificial Sequence
  Description of Artificial Sequence: Synthetic oligonucleotide
gagccgaggctggac

SEQ ID NO: 2467 - DNA, 15 bp, Artificial Sequence
  Description of Artificial Sequence: Synthetic oligonucleotide
ctctgcgagaaacac

SEQ ID NO: 2468 - DNA, 15 bp, Artificial Sequence
  Description of Artificial Sequence: Synthetic oligonucleotide
ccgagattgcagcct

SEQ ID NO: 2469 - DNA, 15 bp, Artificial Sequence
  Description of Artificial Sequence: Synthetic oligonucleotide
gccaccaccccgtct

SEQ ID NO: 2470 - DNA, 15 bp, Artificial Sequence
  Description of Artificial Sequence: Synthetic oligonucleotide
cccggccgccccttc

SEQ ID NO: 2471 - DNA, 15 bp, Artificial Sequence
  Description of Artificial Sequence: Synthetic oligonucleotide
tgtcccatgaccctg

SEQ ID NO: 2472 - DNA, 15 bp, Artificial Sequence
  Description of Artificial Sequence: Synthetic oligonucleotide
aacctccctgcctga

SEQ ID NO: 2473 - DNA, 15 bp, Artificial Sequence
  Description of Artificial Sequence: Synthetic oligonucleotide
tctgtgaccttatcc

SEQ ID NO: 2474 - DNA, 15 bp, Artificial Sequence
  Description of Artificial Sequence: Synthetic oligonucleotide
cggcctcccgaggtg

SEQ ID NO: 2475 - DNA, 15 bp, Artificial Sequence
  Description of Artificial Sequence: Synthetic oligonucleotide
acaatggcggttttg

SEQ ID NO: 2476 - DNA, 15 bp, Artificial Sequence
  Description of Artificial Sequence: Synthetic oligonucleotide
cggagtctcgttcac

SEQ ID NO: 2477 - DNA, 15 bp, Artificial Sequence
  Description of Artificial Sequence: Synthetic oligonucleotide
cccgccgccccgtct

SEQ ID NO: 2478 - DNA, 15 bp, Artificial Sequence
  Description of Artificial Sequence: Synthetic oligonucleotide
ggagcacctctgccc

SEQ ID NO: 2479 - DNA, 15 bp, Artificial Sequence
  Description of Artificial Sequence: Synthetic oligonucleotide
ctggttcactcagtg

SEQ ID NO: 2480 - DNA, 15 bp, Artificial Sequence
  Description of Artificial Sequence: Synthetic oligonucleotide
tctctccacggtctc

SEQ ID NO: 2481 - DNA, 15 bp, Artificial Sequence
  Description of Artificial Sequence: Synthetic oligonucleotide
gaatagaaaggcggg

SEQ ID NO: 2482 - DNA, 15 bp, Artificial Sequence
  Description of Artificial Sequence: Synthetic oligonucleotide
gtgaggagcgcctcc

SEQ ID NO: 2483 - DNA, 15 bp, Artificial Sequence
  Description of Artificial Sequence: Synthetic oligonucleotide
cgccaccccgtctgg

SEQ ID NO: 2484 - DNA, 15 bp, Artificial Sequence
  Description of Artificial Sequence: Synthetic oligonucleotide
caacctacacctccc

SEQ ID NO: 2485 - DNA, 15 bp, Artificial Sequence
  Description of Artificial Sequence: Synthetic oligonucleotide
cccgtctgggaggag

SEQ ID NO: 2486 - DNA, 15 bp, Artificial Sequence
  Description of Artificial Sequence: Synthetic oligonucleotide
ctccactattgtccc

SEQ ID NO: 2487 - DNA, 15 bp, Artificial Sequence
  Description of Artificial Sequence: Synthetic oligonucleotide
gctgcccagtctggg

SEQ ID NO: 2488 - DNA, 15 bp, Artificial Sequence
  Description of Artificial Sequence: Synthetic oligonucleotide
actgggaagtgagga

SEQ ID NO: 2489 - DNA, 15 bp, Artificial Sequence
  Description of Artificial Sequence: Synthetic oligonucleotide
gtgaggagcgcctct

SEQ ID NO: 2490 - DNA, 15 bp, Artificial Sequence
  Description of Artificial Sequence: Synthetic oligonucleotide
ctccactattgtcct

SEQ ID NO: 2491 - DNA, 15 bp, Artificial Sequence
  Description of Artificial Sequence: Synthetic oligonucleotide
tgttgatctgtgacc

SEQ ID NO: 2492 - DNA, 15 bp, Artificial Sequence
  Description of Artificial Sequence: Synthetic oligonucleotide
tccctgcctcgggct

SEQ ID NO: 2493 - DNA, 15 bp, Artificial Sequence
  Description of Artificial Sequence: Synthetic oligonucleotide
aaaaattaaaaaaaa

SEQ ID NO: 2494 - DNA, 15 bp, Artificial Sequence
  Description of Artificial Sequence: Synthetic oligonucleotide
taagagtcatcacca

SEQ ID NO: 2495 - DNA, 15 bp, Artificial Sequence
  Description of Artificial Sequence: Synthetic oligonucleotide
gagacttttcatttt

SEQ ID NO: 2496 - DNA, 15 bp, Artificial Sequence
  Description of Artificial Sequence: Synthetic oligonucleotide
gacggggtttcgccg

SEQ ID NO: 2497 - DNA, 15 bp, Artificial Sequence
  Description of Artificial Sequence: Synthetic oligonucleotide
acataggagactcca

SEQ ID NO: 2498 - DNA, 15 bp, Artificial Sequence
  Description of Artificial Sequence: Synthetic oligonucleotide
ccccgtccgggagga

SEQ ID NO: 2499 - DNA, 15 bp, Artificial Sequence
  Description of Artificial Sequence: Synthetic oligonucleotide
gggaggtgtacccag

SEQ ID NO: 2500 - DNA, 15 bp, Artificial Sequence
  Description of Artificial Sequence: Synthetic oligonucleotide
gagtgcctgggattg

SEQ ID NO: 2501 - DNA, 15 bp, Artificial Sequence
  Description of Artificial Sequence: Synthetic oligonucleotide
ccctctcccctctct

SEQ ID NO: 2502 - DNA, 15 bp, Artificial Sequence
  Description of Artificial Sequence: Synthetic oligonucleotide
tgggccatgatgaca

SEQ ID NO: 2503 - DNA, 15 bp, Artificial Sequence
  Description of Artificial Sequence: Synthetic oligonucleotide
gccgagccaaagctg

SEQ ID NO: 2504 - DNA, 15 bp, Artificial Sequence
  Description of Artificial Sequence: Synthetic oligonucleotide
attatcaataaaaaa

SEQ ID NO: 2505 - DNA, 15 bp, Artificial Sequence
  Description of Artificial Sequence: Synthetic oligonucleotide
gcgagtgatccgcca

SEQ ID NO: 2506 - DNA, 15 bp, Artificial Sequence
  Description of Artificial Sequence: Synthetic oligonucleotide
gaaaggtggggaaaa

SEQ ID NO: 2507 - DNA, 15 bp, Artificial Sequence
  Description of Artificial Sequence: Synthetic oligonucleotide
ccccgtccgggaggt

SEQ ID NO: 2508 - DNA, 15 bp, Artificial Sequence
  Description of Artificial Sequence: Synthetic oligonucleotide
ggactgtactgccgt

SEQ ID NO: 2509 - DNA, 15 bp, Artificial Sequence
  Description of Artificial Sequence: Synthetic oligonucleotide
tcaactcagggttaa

SEQ ID NO: 2510 - DNA, 15 bp, Artificial Sequence
  Description of Artificial Sequence: Synthetic oligonucleotide
aaaaccagagacctt

SEQ ID NO: 2511 - DNA, 15 bp, Artificial Sequence
  Description of Artificial Sequence: Synthetic oligonucleotide
cccgtctgggaagtg

SEQ ID NO: 2512 - DNA, 15 bp, Artificial Sequence
  Description of Artificial Sequence: Synthetic oligonucleotide
gagagatcagattgt

SEQ ID NO: 2513 - DNA, 15 bp, Artificial Sequence
  Description of Artificial Sequence: Synthetic oligonucleotide
cctctccgagaaaca

SEQ ID NO: 2514 - DNA, 15 bp, Artificial Sequence
  Description of Artificial Sequence: Synthetic oligonucleotide
actgtgtctgtgtag

SEQ ID NO: 2515 - DNA, 15 bp, Artificial Sequence
  Description of Artificial Sequence: Synthetic oligonucleotide
ggactgtactgccgc

SEQ ID NO: 2516 - DNA, 15 bp, Artificial Sequence
  Description of Artificial Sequence: Synthetic oligonucleotide
gcttgaaggcagcat

SEQ ID NO: 2517 - DNA, 15 bp, Artificial Sequence
  Description of Artificial Sequence: Synthetic oligonucleotide
tgaggagcgcctccg

SEQ ID NO: 2518 - DNA, 15 bp, Artificial Sequence
  Description of Artificial Sequence: Synthetic oligonucleotide
tgctaagattgcagc

SEQ ID NO: 2519 - DNA, 15 bp, Artificial Sequence
  Description of Artificial Sequence: Synthetic oligonucleotide
tgaggggcgcctctg

SEQ ID NO: 2520 - DNA, 15 bp, Artificial Sequence
  Description of Artificial Sequence: Synthetic oligonucleotide
tccctctgatgccga

SEQ ID NO: 2521 - DNA, 15 bp, Artificial Sequence
  Description of Artificial Sequence: Synthetic oligonucleotide
tgagaacgggccagg

SEQ ID NO: 2522 - DNA, 15 bp, Artificial Sequence
  Description of Artificial Sequence: Synthetic oligonucleotide
tgccgtgatctcggc

SEQ ID NO: 2523 - DNA, 15 bp, Artificial Sequence
  Description of Artificial Sequence: Synthetic oligonucleotide
gaaacacccaagaat

SEQ ID NO: 2524 - DNA, 15 bp, Artificial Sequence
  Description of Artificial Sequence: Synthetic oligonucleotide
gcctaggaaaaccag

SEQ ID NO: 2525 - DNA, 15 bp, Artificial Sequence
  Description of Artificial Sequence: Synthetic oligonucleotide
ccagtgattctcctg

SEQ ID NO: 2526 - DNA, 15 bp, Artificial Sequence
  Description of Artificial Sequence: Synthetic oligonucleotide
ctggttttcgtattt

SEQ ID NO: 2527 - DNA, 15 bp, Artificial Sequence
  Description of Artificial Sequence: Synthetic oligonucleotide
ccatcgtctgggatg

SEQ ID NO: 2528 - DNA, 15 bp, Artificial Sequence
  Description of Artificial Sequence: Synthetic oligonucleotide
gaggtagacatggga

SEQ ID NO: 2529 - DNA, 15 bp, Artificial Sequence
  Description of Artificial Sequence: Synthetic oligonucleotide
tagacataggagact

SEQ ID NO: 2530 - DNA, 15 bp, Artificial Sequence
  Description of Artificial Sequence: Synthetic oligonucleotide
ctggttttcgttttt

SEQ ID NO: 2531 - DNA, 15 bp, Artificial Sequence
  Description of Artificial Sequence: Synthetic oligonucleotide
agacggagtctggtt

SEQ ID NO: 2532 - DNA, 15 bp, Artificial Sequence
  Description of Artificial Sequence: Synthetic oligonucleotide
accctgtgctctctg

SEQ ID NO: 2533 - DNA, 15 bp, Artificial Sequence
  Description of Artificial Sequence: Synthetic oligonucleotide
tgggagacttttcat

SEQ ID NO: 2534 - DNA, 15 bp, Artificial Sequence
  Description of Artificial Sequence: Synthetic oligonucleotide
tctctgaaacatgtg

SEQ ID NO: 2535 - DNA, 15 bp, Artificial Sequence
  Description of Artificial Sequence: Synthetic oligonucleotide
ggtactgctgccatc

SEQ ID NO: 2536 - DNA, 15 bp, Artificial Sequence
  Description of Artificial Sequence: Synthetic oligonucleotide
aaacatgtgctgtgt

SEQ ID NO: 2537 - DNA, 15 bp, Artificial Sequence
  Description of Artificial Sequence: Synthetic oligonucleotide
ggagcccctctgccc

SEQ ID NO: 2538 - DNA, 15 bp, Artificial Sequence
  Description of Artificial Sequence: Synthetic oligonucleotide
aaattgagaaatcgg

SEQ ID NO: 2539 - DNA, 15 bp, Artificial Sequence
  Description of Artificial Sequence: Synthetic oligonucleotide
acacctcccagccgc

SEQ ID NO: 2540 - DNA, 15 bp, Artificial Sequence
  Description of Artificial Sequence: Synthetic oligonucleotide
tggttgccgtgtctg

SEQ ID NO: 2541 - DNA, 15 bp, Artificial Sequence
  Description of Artificial Sequence: Synthetic oligonucleotide
cgagccaaagctgga

SEQ ID NO: 2542 - DNA, 15 bp, Artificial Sequence
  Description of Artificial Sequence: Synthetic oligonucleotide
cggagccgaagctgg

SEQ ID NO: 2543 - DNA, 15 bp, Artificial Sequence
  Description of Artificial Sequence: Synthetic oligonucleotide
gcccctctgcctggc

SEQ ID NO: 2544 - DNA, 15 bp, Artificial Sequence
  Description of Artificial Sequence: Synthetic oligonucleotide
gccgggattgcagac

SEQ ID NO: 2545 - DNA, 15 bp, Artificial Sequence
  Description of Artificial Sequence: Synthetic oligonucleotide
gtctccctctgatgc

SEQ ID NO: 2546 - DNA, 15 bp, Artificial Sequence
  Description of Artificial Sequence: Synthetic oligonucleotide
gtaatcagggacaca

SEQ ID NO: 2547 - DNA, 15 bp, Artificial Sequence
  Description of Artificial Sequence: Synthetic oligonucleotide
gtggggagcgcctct

SEQ ID NO: 2548 - DNA, 15 bp, Artificial Sequence
  Description of Artificial Sequence: Synthetic oligonucleotide
gcgagtgatctgccc

SEQ ID NO: 2549 - DNA, 15 bp, Artificial Sequence
  Description of Artificial Sequence: Synthetic oligonucleotide
ccgtctaggaagtga

SEQ ID NO: 2550 - DNA, 15 bp, Artificial Sequence
  Description of Artificial Sequence: Synthetic oligonucleotide
gttgccgggtctgtg

SEQ ID NO: 2551 - DNA, 15 bp, Artificial Sequence
  Description of Artificial Sequence: Synthetic oligonucleotide
gagaacgggccatga

SEQ ID NO: 2552 - DNA, 15 bp, Artificial Sequence
  Description of Artificial Sequence: Synthetic oligonucleotide
gttgatctgtgacct

SEQ ID NO: 2553 - DNA, 23 bp, Artificial Sequence
  Description of Artificial Sequence: Synthetic primer
cggtaggtgcaatattttagtcc

SEQ ID NO: 2554 - DNA, 23 bp, Artificial Sequence
  Description of Artificial Sequence: Synthetic primer
actgctggataaagcactctaaa

SEQ ID NO: 2555 - DNA, 20 bp, Artificial Sequence
  Description of Artificial Sequence: Synthetic primer
gcctgaaaagcttcgatgac

SEQ ID NO: 2556 - DNA, 20 bp, Artificial Sequence
  Description of Artificial Sequence: Synthetic primer
tggcaaaaactcaattggaa

SEQ ID NO: 2557 - DNA, 19 bp, Artificial Sequence
  Description of Artificial Sequence: Synthetic primer
caccgcccttaatccattt

SEQ ID NO: 2558 - DNA, 20 bp, Artificial Sequence
  Description of Artificial Sequence: Synthetic primer
aaggcagcatgctcgttaag

SEQ ID NO: 2559 - DNA, 20 bp, Artificial Sequence
  Description of Artificial Sequence: Synthetic primer
tcaacatccattcttgacca

SEQ ID NO: 2560 - DNA, 22 bp, Artificial Sequence
  Description of Artificial Sequence: Synthetic primer
caattttggtcaagaatggatg

SEQ ID NO: 2561 - DNA, 23 bp, Artificial Sequence
  Description of Artificial Sequence: Synthetic primer
ttccaataataagccctcaacaa

SEQ ID NO: 2562 - DNA, 24 bp, Artificial Sequence
  Description of Artificial Sequence: Synthetic primer
ccagtctaccctcagtatctagca

SEQ ID NO: 2563 - DNA, 22 bp, Artificial Sequence
  Description of Artificial Sequence: Synthetic primer
catgaggacatggtttgagtct

SEQ ID NO: 2564 - DNA, 18 bp, Artificial Sequence
  Description of Artificial Sequence: Synthetic primer
gcctggacaccactgagc

SEQ ID NO: 2565 - DNA, 20 bp, Artificial Sequence
  Description of Artificial Sequence: Synthetic primer
agggcagcatgctcgttgag

SEQ ID NO: 2566 - DNA, 27 bp, Artificial Sequence
  Description of Artificial Sequence: Synthetic primer
accagtttaataaaagaaacaagaatg

SEQ ID NO: 2567 - DNA, 20 bp, Artificial Sequence
  Description of Artificial Sequence: Synthetic primer
tgctggtgctacttcccttc

SEQ ID NO: 2568 - DNA, 20 bp, Artificial Sequence
  Description of Artificial Sequence: Synthetic primer
aacaagttccatggcaaaca

SEQ ID NO: 2569 - DNA, 20 bp, Artificial Sequence
  Description of Artificial Sequence: Synthetic primer
tcacatcccatgtcacacct

SEQ ID NO: 2570 - DNA, 20 bp, Artificial Sequence
  Description of Artificial Sequence: Synthetic primer
tatccacacagacccagcaa

SEQ ID NO: 2571 - DNA, 20 bp, Artificial Sequence
  Description of Artificial Sequence: Synthetic primer
ggagggaaggtcagcagata

SEQ ID NO: 2572 - DNA, 20 bp, Artificial Sequence
  Description of Artificial Sequence: Synthetic primer
ggcggttttgtggaatagaa

SEQ ID NO: 2573 - DNA, 18 bp, Artificial Sequence
  Description of Artificial Sequence: Synthetic oligonucleotide
ttagtgcttgttgagggc

SEQ ID NO: 2574 - DNA, 18 bp, Artificial Sequence
  Description of Artificial Sequence: Synthetic oligonucleotide
gttagtgcttgttgaggg

SEQ ID NO: 2575 - DNA, 18 bp, Artificial Sequence
  Description of Artificial Sequence: Synthetic oligonucleotide
tgttagtgcttgttgagg

SEQ ID NO: 2576 - DNA, 18 bp, Artificial Sequence
  Description of Artificial Sequence: Synthetic oligonucleotide
atgttagtgcttgttgag

SEQ ID NO: 2577 - DNA, 22 bp, Artificial Sequence
  Description of Artificial Sequence: Synthetic oligonucleotide
aatgttagtgcttgttgagggc

SEQ ID NO: 2578 - RNA, 28 nt, Artificial Sequence
  Description of Artificial Sequence: Synthetic oligonucleotide
agcuuuucaggcuuacauuuacucaucu

SEQ ID NO: 2579 - RNA, 22 nt, Artificial Sequence
  Description of Artificial Sequence: Synthetic oligonucleotide
aauguuagugcuuguugagggc

SEQ ID NO: 2580 - RNA, 21 nt, Artificial Sequence
  Description of Artificial Sequence: Synthetic oligonucleotide
cuagcauacaguaagcacaca

SEQ ID NO: 2581 - RNA, 24 nt, Artificial Sequence
  Description of Artificial Sequence: Synthetic oligonucleotide
cuuuaaaaugcuuuuaagguggua

SEQ ID NO: 2582 - RNA, 21 nt, Artificial Sequence
  Description of Artificial Sequence: Synthetic oligonucleotide
caggcuuacauuuacucaucu

SEQ ID NO: 2583 - RNA, 19 nt, Artificial Sequence
  Description of Artificial Sequence: Synthetic oligonucleotide
gucaucgaagcuuuucagg

SEQ ID NO: 2584 - RNA, 22 nt, Artificial Sequence
  Description of Artificial Sequence: Synthetic oligonucleotide
aauguuagugcuuguugagggc

SEQ ID NO: 2585 - DNA, 22 bp, Artificial Sequence
  Description of Artificial Sequence: Synthetic oligonucleotide
cgcgactatacgcgcaatatgc

SEQ ID NO: 2586 - DNA, 22 bp, Artificial Sequence
  Description of Artificial Sequence: Synthetic primer
tctcagcagtgtagggttttct

SEQ ID NO: 2587 - DNA, 22 bp, Artificial Sequence
  Description of Artificial Sequence: Synthetic primer
tggagcaggaaatgtagcagtt

SEQ ID NO: 2588 - DNA, 20 bp, Artificial Sequence
  Description of Artificial Sequence: Synthetic primer
tcacatcccatgtcacacct

SEQ ID NO: 2589 - DNA, 20 bp, Artificial Sequence
  Description of Artificial Sequence: Synthetic primer
cattcgaacgtctgccctat

SEQ ID NO: 2590 - DNA, 20 bp, Artificial Sequence
  Description of Artificial Sequence: Synthetic primer
caattacagggcctcgaaag

SEQ ID NO: 2591 - DNA, 20 bp, Artificial Sequence
  Description of Artificial Sequence: Synthetic primer
gagtcaacggatttggtcgt

SEQ ID NO: 2592 - DNA, 20 bp, Artificial Sequence
  Description of Artificial Sequence: Synthetic primer
ttgattttggagggatctcg

SEQ ID NO: 2593 - DNA, 21 bp, Artificial Sequence
  Description of Artificial Sequence: Synthetic primer
tgttagtgcttgttgagggct

SEQ ID NO: 2594 - DNA, 20 bp, Artificial Sequence
  Description of Artificial Sequence: Synthetic primer
attcccaggaaggcgctaag

SEQ ID NO: 2595 - DNA, 21 bp, Artificial Sequence
  Description of Artificial Sequence: Synthetic primer
agcatgtgtcaagcattaggt

SEQ ID NO: 2596 - DNA, 21 bp, Artificial Sequence
  Description of Artificial Sequence: Synthetic primer
agtgcttgttgagggcttatt

SEQ ID NO: 2597 - DNA, 28 bp, Artificial Sequence
  Description of Artificial Sequence: Synthetic probe
aggtccagatgagtaaatgtaagcctga

SEQ ID NO: 2598 - DNA, 24 bp, Artificial Sequence
  Description of Artificial Sequence: Synthetic primer
acataagcatgtgtcaagcattag

SEQ ID NO: 2599 - DNA, 20 bp, Artificial Sequence
  Description of Artificial Sequence: Synthetic primer
ccaggaaggcgctaagtaaa

SEQ ID NO: 2600 - DNA, 29 bp, Artificial Sequence
  Description of Artificial Sequence: Synthetic probe
aggtgtgacatgggatgtgattaaactgc

SEQ ID NO: 2601 - DNA, 23 bp, Artificial Sequence
  Description of Artificial Sequence: Synthetic primer
ggtgtgaaccatgagaagtatga

SEQ ID NO: 2602 - DNA, 22 bp, Artificial Sequence
  Description of Artificial Sequence: Synthetic primer
gagtccttccacgataccaaag

SEQ ID NO: 2603 - DNA, 24 bp, Artificial Sequence
  Description of Artificial Sequence: Synthetic probe
agatcatcagcaatgcctcctgca

SEQ ID NO: 2604 - DNA, 24 bp, Artificial Sequence
  Description of Artificial Sequence: Synthetic oligonucleotide
gttttattctaggtccaggtaggt

SEQ ID NO: 2605 - DNA, 24 bp, Artificial Sequence
  Description of Artificial Sequence: Synthetic oligonucleotide
aataagtttttcagacttttttac

SEQ ID NO: 2606 - protein, 6 aa, Artificial Sequence
  Description of Artificial Sequence: Synthetic peptide
GFILGP

SEQ ID NO: 2607 - DNA, 24 bp, Artificial Sequence
  Description of Artificial Sequence: Synthetic oligonucleotide
ttatagatgagtaaatgtaagcct

SEQ ID NO: 2608 - DNA, 24 bp, Artificial Sequence
  Description of Artificial Sequence: Synthetic oligonucleotide
tgttgggaattggagcaggtaagg

SEQ ID NO: 2609 - protein, 6 aa, Artificial Sequence
  Description of Artificial Sequence: Synthetic peptide
LLGIGA

SEQ ID NO: 2610 - RNA, 22 nt, Artificial Sequence
  Description of Artificial Sequence: Synthetic oligonucleotide
aauguuagugcuuguugagggc

SEQ ID NO: 2611 - protein, 6 aa, Artificial Sequence
  Description of Artificial Sequence: Synthetic peptide
ACFTFL

What is claimed is:

1. One or more antisense oligonucleotides complementary to an intronic sequence within a genome, wherein the one or more antisense oligonucleotides comprises a modified backbone, wherein the modified backbone comprises a 2' methoxy ethyl modification or a 2' O-methyl modification, wherein the one or more antisense oligonucleotides binds a splice acceptor site activated by a transposable element or a predicted splice enhancer sequence flanking the splice acceptor site, wherein the one or more antisense oligonucleotides induces exon skipping of an exon, and wherein the one or more antisense oligonucleotides have at least 85% sequence identity to the entire length of the nucleotide sequence AGCUUUUCAGGCUUACAUUUACUCAUCU (SEO ID NO. 2578) or the nucleotide sequence AAUGUUAGUGCUUGUUGAGGGC (SEO ID NO. 2579).

2. The antisense oligonucleotide of claim 1, further comprising at least one modified nucleobase.

3. A set of antisense oligonucleotides comprising 2 or more of the antisense oligonucleotides of claim 1.

4. A pharmaceutical composition comprising of the antisense oligonucleotide of claim 1 in a pharmaceutically acceptable excipient.

5. The one or more antisense oligonucleotides of claim 1, wherein the antisense oligonucleotides further comprise a 5-methyl cytosine and/or a 5-methyl uracil.

* * * * *